United States Patent
Diehn et al.

(10) Patent No.: US 10,667,524 B2
(45) Date of Patent: Jun. 2, 2020

(54) INSECTICIDAL PROTEINS AND METHODS FOR THEIR USE

(71) Applicant: PIONEER HI-BRED INTERNATIONAL, INC., Johnston, IA (US)

(72) Inventors: Scott Diehn, West Des Moines, IA (US); James English, San Ramon, CA (US); Lu Liu, Palo Alto, CA (US); Azalea Ong, Castro Valley, CA (US); Jarred Oral, Fremont, CA (US); Barbara Rosen, Mountain View, CA (US); Ute Schellenberger, Palo Alto, CA (US); Ingrid Udranszky, Mountain View, CA (US); Jun-Zhi Wei, Palo Alto, CA (US); Weiping Xie, East Palo Alto, CA (US); Genhai Zhu, San Jose, CA (US)

(73) Assignee: PIONEER HI-BRED INTERNATIONAL, INC. IA (US)

( * ) Notice: Subject to any disclaimer, the term of this patent is extended or adjusted under 35 U.S.C. 154(b) by 57 days.

(21) Appl. No.: 15/022,109

(22) PCT Filed: Sep. 11, 2014

(86) PCT No.: PCT/US2014/055128
§ 371 (c)(1),
(2) Date: Mar. 15, 2016

(87) PCT Pub. No.: WO2015/038734
PCT Pub. Date: Mar. 19, 2015

(65) Prior Publication Data
US 2016/0366891 A1 Dec. 22, 2016

Related U.S. Application Data

(60) Provisional application No. 61/877,625, filed on Sep. 13, 2013.

(51) Int. Cl.
| | |
|---|---|
| *A01N 63/02* | (2006.01) |
| *A01N 63/10* | (2020.01) |
| *C07K 14/21* | (2006.01) |
| *C12N 15/82* | (2006.01) |
| *C12Q 1/689* | (2018.01) |
| *G01N 33/68* | (2006.01) |

(52) U.S. Cl.
CPC .............. *A01N 63/10* (2020.01); *C07K 14/21* (2013.01); *C12N 15/8286* (2013.01); *C12Q 1/689* (2013.01); *G01N 33/68* (2013.01); *C12Q 2600/13* (2013.01); *G01N 2333/21* (2013.01); *Y02A 40/162* (2018.01)

(58) Field of Classification Search
None
See application file for complete search history.

(56) References Cited

U.S. PATENT DOCUMENTS

| | | |
|---|---|---|
| 2003/0180929 A1 | 9/2003 | Kafefuda et al. |
| 2010/0273198 A1 | 10/2010 | Basu et al. |
| 2012/0233726 A1 | 9/2012 | Abad et al. |
| 2012/0302495 A1 | 11/2012 | Arnaut et al. |
| 2014/0007292 A1 | 1/2014 | Cerf et al. |

FOREIGN PATENT DOCUMENTS

| | | |
|---|---|---|
| WO | 2015/023846 A2 | 2/2015 |
| WO | 2015/038734 A2 | 3/2015 |
| WO | 2015/130890 A1 | 9/2015 |
| WO | 2015/130893 A1 | 9/2015 |
| WO | 2015/134256 A1 | 9/2015 |

OTHER PUBLICATIONS

NCBI Reference Sequence: WP_012730641.1, downloaded on Aug. 3, 2017 from URL:<https://www.ncbi.nlm.nih.gov/protein/WP_012730641.1>.*
NCBI Reference Sequence WP016417435.1, downloaded on Aug. 3, 2017 from URL:<https://www.ncbi.nlm.nih.gov/protein/WP_016417435.1>.*
International Search Report and Written Opinion for International Application PCT/US16/20634 dated Aug. 5, 2016.
NCBI Reference Sequence WP_016417435.1.
NCBI Reference Sequence: WP_030131237.
NCBI Reference Sequence: WP_025804131.1.
International Search Report and Written Opinion for International Application PCT/US14/55128 dated Apr. 13, 2015.
UniProt Submission C4KSV9.
NCBI Accession No. YP_004842361.1.
NCBI Accession No. YP_002897852.
Anonymous: "Toward two decades of plant biotechnology: successes, failures, and prospects—Halford—2012—Food and Energy Security—Wiley Online Library", Jul. 1, 2012 (Jul. 1, 2012), XP055341570, retrieved from the Internet: URL: http://onlinelibrary.wiley.c,om/doi/10.1002/fes3.3/full.

(Continued)

*Primary Examiner* — Sergio Coffa

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, fungal, Hemipteran and nematode pest populations and for producing compositions with insecticidal activity.

30 Claims, 4 Drawing Sheets

Figure 6:
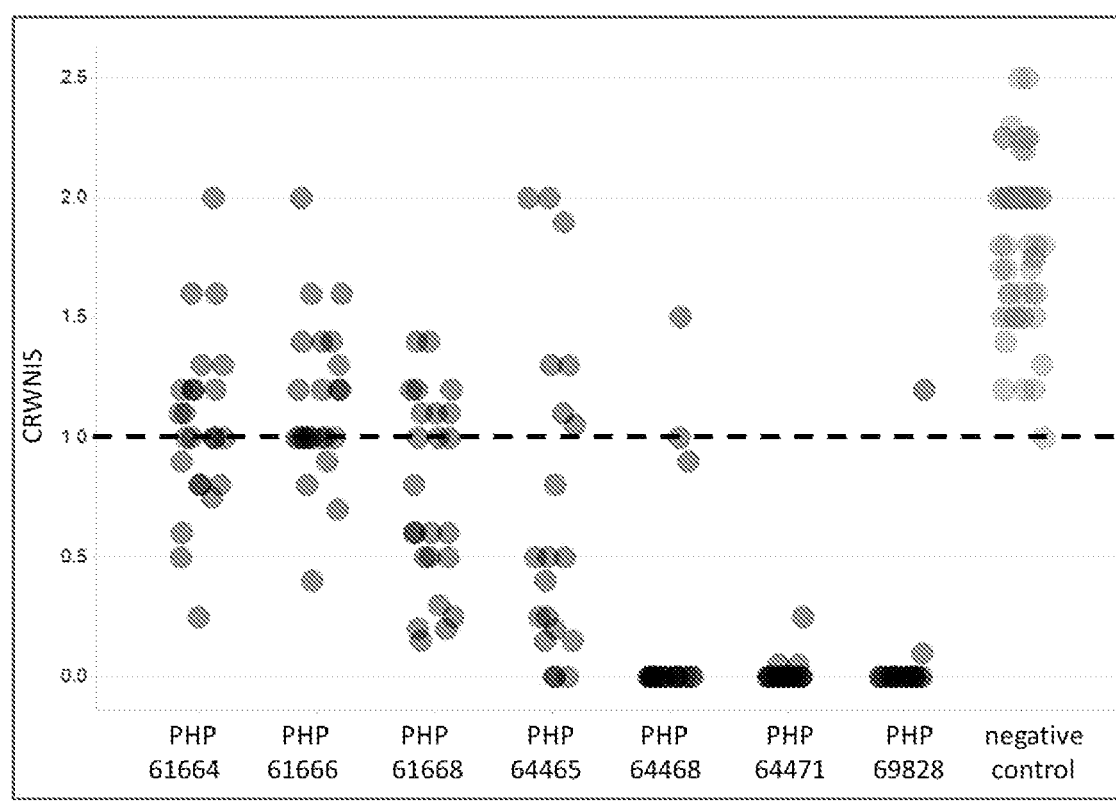

Specification includes a Sequence Listing.

(56) References Cited

OTHER PUBLICATIONS

Kupferschmied, Peter; et al.: "Promise for plant pest control: root-associated pseudomonads with insecticidal activities," Frontiers in Plant Science, Jan. 1, 2013 (Jan. 1, 2013), vol. 4, XP055341564.
Schellenberger, Ute; et al.: "A selective insecticidal protein from Pseudomonas for controlling corn rootworms," Science, Nov. 4, 2016 (Nov. 4, 2016), vol. 354, Issue 6312, pp. 634-637.
European Supplementary Search Report for Application No. EP 14 84 3248, completed Feb. 6, 2017.
Chen, et al.: "Characterization of an Insecticidal Toxin and Pathogenicity of *Pseudomonas taiwanensis* against Insects", PLoS Pathogens, Aug. 21, 2014 (Aug. 21, 2014), vol. 10, Iss. 8, pp. 1-14. (e1004288).
International Search Report; Written Opinion; and International Preliminary Report on Patentability for International Application No. PCT/US2016/020642, dated May 31, 2016.

* cited by examiner

Fig. 1

```
                        1                                                50
PIP-72Aa      (1)  --MGITVTNNSSNPIEVAINHWGSDG--DTSFFSVGNGKQETWDRSDSRG
PIP-72Ba      (1)  --MGITVKNNSSNTIEVAVNHWGKDG--DTSFFSIANGKQESWDRSDSRG
PIP-72Ca      (1)  --MGITVTNKSSKKIEVSINKWGSDG--DTTFFGVDSGKQESWDRSDDRG
PIP-72Cb      (1)  --MGITVTNKSSKKIEVSVNKWGSDG--DTTFFGIDSGKQESWDRSDDRG
PIP-72Da      (1)  --MGITVTNKSSKKIEASINKWGSDG--DTKFFGIDSGKQESWDRSDDRG
PIP-72Db      (1)  --MGITVTNKSSKKIEASINKWGSDG--DTKFFGIDSGKQESWDRSDDRG
PIP-72Dc      (1)  --MGITVTNKSSKKIEASINKWGSDG--DTKFFGIDSGKQESWDRSDDRG
PIP-72Ea      (1)  --MSITVKNNTSNIIEVAINQWDTDG--DTRYSPLAAGASDKWVRKDSRG
PIP-72Fa      (1)  --MKLTITNGASTSIDIAVSAWRNDG--NDSYYSIAQGESDTWDRSDARG
GBP_A3175     (1)  --MAISVKNSASNTVEVSINHWGTDG--DTKPFKMAPGASDSWDRNDLRG
SRBS_294080   (1)  --MSITITNGASQTVQIAVSVWGRDG--SDDYYSLEPGKGDTWGRNDPRG
JG43047       (1)  MNMSITVTNGASTVVNVAISTWEKDG--SDAYWPLEQGKGDTWKRSDPRG
SwiRh_4910    (1)  --MSITITNGASRTVQIAVSVWGRDG--SDDYYSLEPGKGDTWGRNDPRG
PIP-72Ff      (1)  --MSITITNGASRTVQIAVSVWGRDG--SDDYYSLEPGKGDTWGRNDPRG
PIP-72Ga      (1)  --MSISITNAGSREIQVAVSTWSTDSDISDAYYSLAPDKGDKWKRNDPRG
PIP-72Gb      (1)  --MSITVTNGASTVVNVAISTWEKDG--SDAYYPLEQGNGDTWKRSDPRG
XBJ1_1078     (1)  ----MKIINNTQSNIIVSVNKWGDDG--QTGRFTVSPGRSGSWNRTDERG
plu2373       (1)  ---MIIVKNSSNKVTKVSINKWGKDG--NTGYWDINPGDTASWNRTDGRG
PIP-72Ge      (1)  MNMSITVTNGASAVVNVAISTWEKDG--SDAYYPLEQGSGDTWKRSDPRG 51                                               100
PIP-72Aa     (47)  FVLSLKKNG-AQHPYYVQASSKIEVDNNAVKDQGRLIEPLS---------
PIP-72Ba     (47)  FVLSLKRNG-AQHPYYVQASSQIEVDHNAVKDHGEPIHPLS---------
PIP-72Ca     (47)  FVLSLKRNG-TQAPYYVQATSKIEVDSSTVKDHGETIHPVA---------
PIP-72Cb     (47)  FVLSLKRNG-TQAPYYVQATSKIEVDSSTVKDHGETIHPVA---------
PIP-72Da     (47)  FVLSLKRNG-TQAPYYVQATSKIEIENSTVKDHGETIHPVA---------
PIP-72Db     (47)  FVLSLKRNG-TQAPYYVQATSKIEVENSMVKDHGETIHPVA---------
PIP-72Dc     (47)  FVLSLKRNG-TQAPYYVQATSKIEIENSAVKDHGETIHPVA---------
PIP-72Ea     (47)  YVLSLRQGG-TEKPYYVLVDSNIVVANTEVKDNDTVISPISR--------
PIP-72Fa     (47)  YLMAVKMKS-QVKTYYISQTSKIVVEDNIVKDHGQTLNPLYAVNNM----
GBP_A3175    (47)  FVMYVQLGG-SATPYYVLSTSNIVIYDDKVTDSGQTLLPANKRFG-----
SRBS_294080  (47)  YLMAIKAN--PAGVYYVAFDSQIVIEDNLVKDRGRTINPLASNNQ-----
JG43047      (49)  YLMAIQDKS-QTTEYYVTCNSVIVIEDNLVKDHGRTLNPLAAAGKKNVVNA
SwiRh_4910   (47)  YLMAIKGQT-QAGVYYVAFDSQIVIEDNLVKDRGRTINPLASNNQ-----
PIP-72Ff     (47)  YLMAIKGQT-QAGVYYVAFDSQIVIEDNLVKDRGRTINPLASNNQ-----
PFL_6283     (49)  YLMTVKGQS-QQGVYYVAFDSEIFIEDSLVKDRGKTITKLALEVQ-----
PIP-72Gb     (47)  YLMAIQDKS-QTTEYYVTCNSVIVIEDNLVKDHGRTLNPVAAAGKRKVANA
XBJ1_1078    (45)  FVMAILKKG-VQDSFYIFSDSDIKVFDSYVTDGRRIKPATDRYY-----
plu2373      (46)  FVMSIIRENEDQKSYFVLANSNIVIYDKDATGYGKNVQDNGRWIYPLN--
PIP-72Ge     (49)  YLMAIQDKS-QTTEYYVSCNSAIVIEDNLVKDHGRTLNPVAAAGKKKVANA
```

Fig. 2

```
                        1                                                  50
PIP-72Aa       (1)  MGITVTNNSSNPIEVAINHWGSDGDTSFFSVGNGKQETWDRSDSRGFVLS
PIP-72Ab       (1)  MGITVKNNSSNPIEVAINRWGNDGDTNFFSVGNGKQETWDRSDSRGFVLS
PIP-72Ba       (1)  MGITVKNNSSNTIEVAVNHWGKDGTSFFSIANGKQESWDRSDSRGFVLS
PIP-72Bb       (1)  MGITVKNNSSNTIEVAVNHWGSDGTSFFSIANGKQESWDRSDSRGFVLS
PIP-72Ca       (1)  MGITVTNKSSKKIEVSINKWGSDGDTTFFGVDSGKQESWDRSDDRGFVLS
PIP-72Cb       (1)  MGITVTNKSSKKIEVSVNKWGSDGDTTFFGIDSGKQESWDRSDDRGFVLS
WP_030131237   (1)  MGITVTNNSSHTIEVAINQWGDDGDTSFFSIANGKNESWDRSDDRGFVLS
PIP-72Da       (1)  MGITVTNKSSKKIEASINKWGSDGDTKFFGIDSGKQESWDRSDDRGFVLS
PIP-72Db       (1)  MGITVTNKSSKKIEASINKWGSDGDTKFFGIDSGKQESWDRSDDRGFVLS
PIP-72Dc       (1)  MGITVTNKSSKKIEASINKWGSDGDTKFFGIDSGKQESWDRSDDRGFVLS
PIP-72Fa       (1)  MKLTITNGASTSIDIAVSAWRNDGNDSYYSIAQGESDTWDRSDARGYLMA
GBP_A3175      (1)  MAISVKNSASNTVEVSINHWGTDGDTKPFKMAPGASDSWDRNDLRGFVMY
                        51                                         91
PIP-72Aa      (51)  LKKNGAQHPYYVQASSKIEVDNNAVKDQGRLIEPLS-----
PIP-72Ab      (51)  LKKNGAQHPYYVQASSKIEVDNNAVKDQGQLIEPLS-----
PIP-72Ba      (51)  LKRNGAQHPYYVQASSQIEVDHNAVKDHGEPIHPLS-----
PIP-72Bb      (51)  LKKNGAQHPYYVQASSRIEVDNNAVKDQGQPIQPLS-----
PIP-72Ca      (51)  LKRNGTQAPYYVQATSKIEVDSSTVKDHGETIHPVA-----
PIP-72Cb      (51)  LKRNGTQAPYYVQATSKIEVDSSTVKDHGETIHPVA-----
WP_030131237  (51)  LQKNGAQYPYYVQASSNIKVDNNGVTDQGEAIYPLA-----
PIP-72Da      (51)  LKRNGTQAPYYVQATSKIEIENSTVKDHGETIHPVA-----
PIP-72Db      (51)  LKRNGTQAPYYVQATSKIEVENSMVKDHGETIHPVA-----
PIP-72Dc      (51)  LKRNGTQAPYYVQATSKIEIENSAVKDHGETIHPVA-----
PIP-72Fa      (51)  VKMKSQVKTYYISQTSKIVVEDNIVKDHGQTLNPLYAVNNM
GBP_A3175     (51)  VQLGGSATPYYVLSTSNIVIYDDKVTDSGQTLLPANKRFG-
```

Fig. 3

```
                    1                                                  50
PIP-72Aa    (1)  MGITVTNNSSNPIEVAINHWGSDGDTSFFSVGNGKQETWDRSDSRGFVLS
PIP-72Ba    (1)  MGITVKNNSSNTIEVAVNHWGKDGTSFFSIANGKQESWDRSDSRGFVLS
PIP-72Ca    (1)  MGITVTNKSSKKIEVSINKWGSDGDTTFFGVDSGKQESWDRSDDRGFVLS
PIP-72Cb    (1)  MGITVTNKSSKKIEVSVNKWGSDGDTTFFGIDSGKQESWDRSDDRGFVLS
PIP-72Da    (1)  MGITVTNKSSKKIEASINKWGSDGDTKFFGIDSGKQESWDRSDDRGFVLS
PIP-72Db    (1)  MGITVTNKSSKKIEASINKWGSDGDTKFFGIDSGKQESWDRSDDRGFVLS
PIP-72Dc    (1)  MGITVTNKSSKKIEASINKWGSDGDTKFFGIDSGKQESWDRSDDRGFVLS 51                                     87
PIP-72Aa   (51)  LKKNGAQHPYYVQASSKIEVDNNAVKDQGRLIEPLS-
PIP-72Ba   (51)  LKRNGAQHPYYVQASSQIEVDHNAVKDHGEPIHPLS-
PIP-72Ca   (51)  LKRNGTQAPYYVQATSKIEVDSSTVKDHGETIHPVA-
PIP-72Cb   (51)  LKRNGTQAPYYVQATSKIEVDSSTVKDHGETIHPVA-
PIP-72Da   (51)  LKRNGTQAPYYVQATSKIEIENSTVKDHGETIHPVA-
PIP-72Db   (51)  LKRNGTQAPYYVQATSKIEVENSMVKDHGETIHPVA-
PIP-72Dc   (51)  LKRNGTQAPYYVQATSKIEIENSAVKDHGETIHPVA-
```

Fig. 4

```
                  1                                                  50
WP_030131237   (1) MGITVTNNSSHTIEVAINQWGDDGDTSFFSIANGKNESWDRSDDRGFVLS
 PIP-72Ca      (1) MGITVTNKSSKKIEVSINKWGSDGDTTFFGVDSGKQESWDRSDDRGFVLS
 PIP-72Cb      (1) MGITVTNKSSKKIEVSVNKWGSDGDTTFFGIDSGKQESWDRSDDRGFVLS
 PIP-72Db      (1) MGITVTNKSSKKIEASINKWGSDGDTKFFGIDSGKQESWDRSDDRGFVLS
 PIP-72Da      (1) MGITVTNKSSKKIEASINKWGSDGDTKFFGIDSGKQESWDRSDDRGFVLS
 PIP-72Dc      (1) MGITVTNKSSKKIEASINKWGSDGDTKFFGIDSGKQESWDRSDDRGFVLS 51                                      86
WP_030131237  (51) LQKNGAQYPYYVQASSNIKVDNNGVTDQGEAIYPLA
 PIP-72Ca     (51) LKRNGTQAPYYVQATSKIEVDSSTVKDHGETIHPVA
 PIP-72Cb     (51) LKRNGTQAPYYVQATSKIEVDSSTVKDHGETIHPVA
 PIP-72Db     (51) LKRNGTQAPYYVQATSKIEVENSMVKDHGETIHPVA
 PIP-72Da     (51) LKRNGTQAPYYVQATSKIEIENSTVKDHGETIHPVA
 PIP-72Dc     (51) LKRNGTQAPYYVQATSKIEIENSAVKDHGETIHPVA
```

Fig. 5

```
                  1                                                  50
IPD072Fh      (1) MKLTITNGASTSIDIAVSAWRNDGNDSYYSIAQGESDTWDRSDARGYLMA
IPD072Gi      (1) MKLTITNGASTSVDIAVSTWRNDGNDSYYSIAQGESDTWDRSDARGYLMA
IPD072Fi      (1) MKLTITNGASTSIEIAVSAWRNDGNDSYYSIAQGESDTWDRSDARGYLMA
IPD072Gl      (1) MKLTITNGASTSIEIAVSAWRNDGNDSYYSIAQGESDTWDRSDARGYLMA
 PIP-72Fa     (1) MKLTITNGASTSIDIAVSAWRNDGNDSYYSIAQGESDTWDRSDARGYLMA 51                                              91
IPD072Fh     (51) VKMKSQVKTYYISQASKIVVEDNLVKDHGQTINPLYAVNSM
IPD072Gi     (51) VKMKSQVKTYYISQTSKIVVEDNLVKDHGQTLNPLYAVNNM
IPD072Fi     (51) VKMKSQVKTYYISQTSKIVVEDNIVKDHGQTLNPLYAANNM
IPD072Gl     (51) VKMKSQVKTYYISQTSKIVVEDNIVKDHGQTLNPLYAVNNM
 PIP-72Fa    (51) VKMKSQVKTYYISQTSKIVVEDNIVKDHGQTLNPLYAVNNM
```

INSECTICIDAL PROTEINS AND METHODS FOR THEIR USE

CROSS REFERENCE

This application is a 371 (National Stage) of PCT/US14/55128 filed Sep. 11, 2014, which claims the benefit of U.S. Provisional Application No. 62/877,625 filed Sep. 13, 2013, which are incorporated herein by reference in their entirety.

A sequence listing having the file name "5345PCT_sequence_listing.txt" created on Aug. 28, 2014, and having a size of 576 kilobytes is filed in computer readable form concurrently with the specification. The sequence listing is part of the specification and is herein incorporated by reference in its entirety.

FIELD OF THE INVENTION

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND OF THE INVENTION

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of Bt. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera including but not limited to insect pests that have developed resistance to existing insecticides.

SUMMARY OF THE INVENTION

Compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues and seeds.

In particular, isolated or recombinant nucleic acid molecules are provided encoding *Pseudomonas* Insecticidal Protein-72 (PIP-72) polypeptides including amino acid substitutions, deletions, insertions, and fragments thereof, and combinations thereof. Additionally, amino acid sequences corresponding to the PIP-72 polypeptides are encompassed. Provided are isolated or recombinant nucleic acid molecules capable of encoding a PIP-72 polypeptide of SEQ ID NO: 849 as well as amino acid substitutions, deletions, insertions, fragments thereof and combinations thereof. Nucleic acid sequences that are complementary to a nucleic acid sequence of the embodiments or that hybridize to a sequence of the embodiments are also encompassed. Also provided are isolated or recombinant PIP-72 polypeptides of SEQ ID NO: 849 as well as amino acid substitutions, deletions, insertions, fragments thereof and combinations thereof.

Methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

Methods for detecting the nucleic acids and polypeptides of the embodiments in a sample are also included. A kit for detecting the presence of a PIP-72 polypeptide or detecting the presence of a nucleotide sequence encoding a PIP-72 polypeptide in a sample is provided. The kit may be provided along with all reagents and control samples necessary for carrying out a method for detecting the intended agent, as well as instructions for use.

The compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of PIP-72 polypeptides or nucleic acids in products or organisms.

BRIEF DESCRIPTION OF THE FIGURES

FIG. 1 shows the amino acid sequence alignment of PIP-72Aa (SEQ ID NO: 2), PIP-72Ba (SEQ ID NO: 4);

PIP-72Ca (SEQ ID NO: 6); PIP-72Cb (SEQ ID NO: 8); PIP-72 Da (SEQ ID NO: 10); PIP-72Db (SEQ ID NO: 12); PIP-72Dc (SEQ ID NO: 14); PIP-72Ea (SEQ ID NO: 16), PIP-72Fa (SEQ ID NO: 18); GBP_A3175 (SEQ ID NO: 20), SRBS_294080 (SEQ ID NO: 22); JG43047 (SEQ ID NO: 24); SwiRh_4910 (SEQ ID NO: 26); PIP-72Ff (SEQ ID NO: 28), PFL_6283 (SEQ ID NO: 30); PIP-72Gb (SEQ ID NO: 32); XBJ1_1078 (SEQ ID NO: 34); plu2373 (SEQ ID NO: 36); and PIP-72Ge (SEQ ID NO: 38). The sequence diversity is highlighted. Amino acids 37-51 (Motif 1) relative to PIP-72Aa (SEQ ID NO: 2) are underlined.

FIG. 2 shows an alignment of the amino acid sequences of PIP-72Aa (SEQ ID NO: 2), PIP-72Ab (SEQ ID NO: 927); PIP-72Ba (SEQ ID NO: 4); PIP-72Bb (SEQ ID NO: 928); PIP-72Ca (SEQ ID NO: 6); PIP-72Cb (SEQ ID NO: 8); WP_030131237 (SEQ ID NO: 929); PIP-72 Da (SEQ ID NO: 10); PIP-72Db (SEQ ID NO: 12); PIP-72Dc (SEQ ID NO: 14); PIP-72Fa (SEQ ID NO: 18); and GBP_A3175 (SEQ ID NO: 20). The amino acid diversity between PIP-72Aa (SEQ ID NO: 2) and the other homologs is indicated with shading.

FIG. 3 shows the amino acid sequence alignment of PIP-72Aa (SEQ ID NO: 2), PIP-72Ba (SEQ ID NO: 4); PIP-72Ca (SEQ ID NO: 6); PIP-72Cb (SEQ ID NO: 8); PIP-72 Da (SEQ ID NO: 10); PIP-72Db (SEQ ID NO: 12); and PIP-72Dc (SEQ ID NO: 14). The amino acid diversity between PIP-72Aa (SEQ ID NO: 2) and the other homologs is indicated with shading.

FIG. 4 shows the amino acid sequence alignment of WP_030131237 (SEQ ID NO: 929) PIP-72Ca (SEQ ID NO: 6); PIP-72Cb (SEQ ID NO: 8); PIP-72 Da (SEQ ID NO: 10); PIP-72Db (SEQ ID NO: 12); and PIP-72Dc (SEQ ID NO: 14). The amino acid diversity between PIP-72 Da (SEQ ID NO: 10) and the other homologs is indicated with shading.

FIG. 5 shows an alignment of the amino acid sequences of PIP-72Fh (SEQ ID NO: 932), PIP-72Gi (SEQ ID NO: 941); PIP-72Fi (SEQ ID NO: 933); PIP-72GI (SEQ ID NO: 944); PIP-72Fa (SEQ ID NO: 14). The amino acid diversity between PIP-72Ca (SEQ ID NO: 2) and the other homologs is indicated with shading.

FIG. 6 shows the T0 GH efficacy results for events generated from the PHP61664, PHP61666, PHP61668, PHP64465, PHP64468, PHP64471, and PHP69828 constructs. Efficacy for events derived from the constructs was observed relative to negative control events as measured by root protection from Western corn rootworm. Root protection was measured according to the number of nodes of roots injured (CRWNIS=corn rootworm node injury score) using the method developed by Oleson, et al. (2005) [*J. Econ Entomol.* 98(1):1-8]. The root injury score is measured from "0" to "3" with "0" indicating no visible root injury, "1" indicating 1 node of root damage, "2" indicating 2 nodes or root damage, and "3" indicating a maximum score of 3 nodes of root damage. Each symbol (triangle, square or circle) represents a single event.

DETAILED DESCRIPTION

It is to be understood that this disclosure is not limited to the particular methodology, protocols, cell lines, genera, and reagents described, as such may vary. It is also to be understood that the terminology used herein is for the purpose of describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding a PIP-72 polypeptide. In particular, the nucleic acid sequences of the embodiments are useful for preparing plants and microorganisms that possess pesticidal activity. Thus, transformed bacteria, plants, plant cells, plant tissues and seeds are provided. The compositions are pesticidal nucleic acids and proteins of bacterial species. The nucleic acid sequences find use in the construction of expression vectors for subsequent transformation into organisms of interest, as probes for the isolation of other homologous (or partially homologous) genes, and for the generation of altered PIP-72 polypeptides by methods known in the art, such as site-directed mutagenesis, domain swapping or DNA shuffling. The PIP-72 polypeptides find use in controlling or killing Lepidopteran, Coleopteran, Dipteran, fungal, Hemipteran and nematode pest populations and for producing compositions with pesticidal activity. Insect pests of interest include, but are not limited to, Lepidoptera species including but not limited to: diamond-back moth, e.g., *Helicoverpa zea* Boddie; soybean looper, e.g., *Pseudoplusia includens* Walker; and velvet bean caterpillar e.g., *Anticarsia gemmatalis* Hübner and Coleoptera species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW.

By "pesticidal toxin" or "pesticidal protein" is used herein to refer to a toxin that has toxic activity against one or more pests, including, but not limited to, members of the Lepidoptera, Diptera, Hemiptera and Coleoptera orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) *PLoS Pathogens* 7:1-13); from *Pseudomonas protegens* strain CHA0 and Pf-5 (previously *fluorescens*) (Pechy-Tarr, (2008) *Environmental Microbiology* 10:2368-2386; GenBank Accession No. EU400157); from *Pseudomonas Taiwanensis* (Liu, et al., (2010) *J. Agric. Food Chem.,* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal,* 3:101-118 and Morgan, et al., (2001) *Applied and Envir. Micro.* 67:2062-2069); U.S. Pat. Nos. 6,048,838, and 6,379, 946; a PIP-1 polypeptide of U.S. Ser. No. 13/792,861; an AflP-1A and/or AflP-1B polypeptides of U.S. Ser. No. 13/800,233; a PHI-4 polypeptides of U.S. Ser. No. 13/839, 702; PIP-47 polypeptides of U.S. Ser. No. 61/866,747; the insecticidal proteins of U.S. Ser. Nos. 61/863,761 and 61/863763; and δ-endotoxins including but not limited to: the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51, Cry52, Cry 53, Cry 54, Cry55, Cry56, Cry57, Cry58, Cry59. Cry60, Cry61, Cry62, Cry63, Cry64, Cry65, Cry66, Cry67, Cry68, Cry69, Cry70 and Cry71 classes of δ-endotoxin genes and the *B. thuringiensis* cytolytic cyt1 and cyt2 genes. Members of these classes of *B. thuringiensis* insecticidal proteins include, but are not limited to Cry1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession # AAA86265); Cry1Aa7 (Accession # AAD46139); Cry1Aa8 (Accession #I26149); Cry1Aa9 (Accession # BAA77213); Cry1Aa10 (Accession # AAD55382); Cry1Aa11 (Accession # CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession #I12419); Cry1Ab12 (Accession # AAC64003); Cry1Ab13 (Accession # AAN76494); Cry1Ab14 (Accession # AAG16877); Cry1Ab15 (Accession # AAO13302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession #I12418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession # FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AAO39719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # AB020894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AAO39720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1] (Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession #I76415); Cry1Da3 (Accession # HQ439784); Cry1 Db1 (Accession # CAA80234); Cry1 Db2 (Accession # AAK48937); Cry1 Dc1 (Accession # ABK35074); Cry1Ea1 (Accession # CAA37933); Cry1Ea2 (Accession # CAA39609); Cry1Ea3 (Accession # AAA22345); Cry1Ea4 (Accession # AAD04732); Cry1Ea5 (Accession # A15535); Cry1Ea6 (Accession # AAL50330); Cry1Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1 Fb1 (Accession # CAA80235); Cry1Fb2 (Accession # BAA25298); Cry1Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AAO13756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession #

CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession # ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1Id1 (Accession # AAD44366); Cry1Id2 (Accession # JQ228422); Cry1Ie1 (Accession # AAG43526); Cry1Ie2 (Accession # HM439636); Cry1Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession # ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession # AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession # AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # AB183671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession # JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CAO78739); Cry2Ae1 (Accession # AAQ52362); Cry2Af1 (Accession # AB030519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession # I15475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession # I34543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # ACI44005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession #

ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession #I32932); Cry21Aa2 (Accession #I66477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession #I34547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # ACI22625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BA144026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BA144022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # KC156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession # KC156690);

Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676); Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # AB114444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession # ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EAO57254); Cry60Aa3 (Accession # EEM99278); Cry60Ba1 (Accession # GU810818); Cry60Ba2 (Accession # EAO57253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509); Cry63Aa1 (Accession # BA144028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession # ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # ADO51070); Cry70Bb1 (Accession # EEL67276); Cry71Aa1 (Accession # JX025568); Cry72Aa1 (Accession # JX025569); Cyt1Aa (GenBank Accession Number X03182); Cyt1Ab (GenBank Accession Number X98793); Cyt1B (GenBank Accession Number U37196); Cyt2A (GenBank Accession Number Z14147); and Cyt2B (GenBank Accession Number U52043).

Examples of δ-endotoxins also include but are not limited to Cry1A proteins of U.S. Pat. Nos. 5,880,275, 7,858,849 8,530,411, 8,575,433, and 8,686,233; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families, including but not limited to the Cry9D protein of U.S. Pat. No. 8,802,933 and the Cry9B protein of U.S. Pat. No. 8,802,934; a Cry15 protein of Naimov, et al., (2008) *Applied and Environmental Microbiology*, 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US Patent Application Publication Number 2008/0295207; ET29, ET37, TIC809, TIC810, TIC812, TIC127, TIC128 of PCT US 2006/033867; TIC853 toxins of U.S. Pat. No. 8,513,494, AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Publication Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462;

AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247 and U.S. Pat. No. 8,759,619; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent Application Publication Number 2010/0005543, AXMI270 of US Patent Application Publication US20140223598, AXMI279 of US Patent Application Publication US20140223599, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database, which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); Cry1Ab & Cry1F (US20140182018); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

In some embodiments the PIP-72 polypeptides include amino acid sequences deduced from the full-length nucleic acid sequences disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of PIP-72 polypeptides. The protein resulting from translation of these PIP-72 polypeptide genes allows cells to control or kill pests that ingest it.

Bacterial Strains

One aspect pertains to bacterial strains that express a PIP-72 polypeptide. In some embodiments the bacterial strain is a *Halomonas, Photorhabdus, Xenorhabdus, Burkholderia, Paludibacterium* or *Pseudomonas* species. In some embodiments the bacterial strain is a *Halomonas anticariensis, Photorhabdus luminescens, Xenorhabdus bovienii, Burkholderia pseudomallei, Burkholderia multivorans, Burkholderia thailandensis, Paludibacterium yongneupense, Pseudomonas rhodesiae; Pseudomonas entomophila, Pseudomonas chlororaphis; Pseudomonas mandelii; Pseudomonas congelans; Pseudomonas mandelii; Pseudomonas plecoglossicida, Pseudomonas protegens, Pseudomonas ficuserectae; Pseudomonas mosselii* or *Pseudomonas brassicacearum* strain. In some embodiments the bacterial strain is a biologically pure culture of a *Pseudomonas chlororaphis* strain SS143D5, deposited on Feb. 7, 2013 under accession # NRRL B-50810 with the Agricultural Research Service Culture Collection (NRRL), 1815 North University Street, Peoria, Ill. 61604, (nrrl.ncaur.usda.gov, which can be accessed on the world-wide web using the "www" prefix). The deposit will be maintained under the terms of the Budapest Treaty on the International Recognition of the Deposit of Microorganisms for the Purposes of Patent Procedure. These deposits were made merely as a convenience for those of skill in the art and are not an admission that a deposit is required under 35 U.S.C. § 112. Access to this deposit will be available during the pendency of the application to the Commissioner of Patents and Trademarks and persons determined by the Commissioner to be entitled thereto upon request. Upon allowance of any claims in the application, the Applicant(s) will make available to the public, pursuant to 37 C.F.R. § 1.808, sample(s) of the deposit of with the Agricultural Research Service Culture Collection (NRRL), 1815 North University Street, Peoria, Ill. 61604. This deposit will be maintained in the NRRL depository, which is a public depository, for a period of 30 years or 5 years after the most recent request or for the enforceable life of the patent, whichever is longer, and will be replaced if it becomes nonviable during that period. The deposits will irrevocably and without restriction or condition be available to the public upon issuance of a patent. Additionally, Applicant(s) have satisfied all the requirements of 37 C.F.R. §§ 1.801-1.809, including providing an indication of the viability of the sample upon deposit. Applicant(s) have no authority to waive any restrictions imposed by law on the transfer of biological material or its transportation in commerce. Applicant(s) do not waive any infringement of their rights granted under this patent. However, it should be understood that the availability of a deposit does not constitute a license to practice the subject invention in derogation of patent rights granted by government action.

Nucleic Acid Molecules, and Variants and Fragments Thereof

One aspect pertains to isolated or recombinant nucleic acid molecules comprising nucleic acid sequences encoding PIP-72 polypeptides or biologically active portions thereof, as well as nucleic acid molecules sufficient for use as hybridization probes to identify nucleic acid molecules encoding proteins with regions of sequence homology. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecule encoding a PIP-72 polypeptide can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments an isolated nucleic acid molecule encoding a PIP-72 polypeptide has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments the nucleic acid molecule encoding a PIP-72 polypeptide is a non-genomic sequence.

A variety of polynucleotides that encode a PIP-72 polypeptides or related proteins are contemplated. Such polynucleotides are useful for production of PIP-72 polypeptides in host cells when operably linked to suitable promoter, transcription termination and/or polyadenylation sequences. Such polynucleotides are also useful as probes for isolating homologous or substantially homologous polynucleotides that encode PIP-72 polypeptides or related proteins.

Sources of polynucleotides that encode PIP-72 polypeptides or related proteins include but not limited to *Halomonas anticariensis, Photorhabdus luminescens, Xenorhabdus bovienii, Burkholderia pseudomallei, Burkholderia multivorans, Burkholderia thailandensis, Paludibacterium yongneupense, Pseudomonas rhodesiae; Pseudomonas entomophila, Pseudomonas chlororaphis; Pseudomonas mandelii; Pseudomonas congelans; Pseudomonas mandelii; Pseudomonas plecoglossicida, Pseudomonas protegens, Pseudomonas ficuserectae; Pseudomonas mosselii* or *Pseudomonas brassicacearum* strain. Sources of polynucleotides that encode PIP-72 polypeptides or related proteins include but not limited to: a *Pseudomonas chlororaphis* strain which contains the PIP-72Aa polynucleotide of SEQ ID NO: 1 encoding the PIP-72Aa polypeptide of SEQ ID NO: 2; a *Pseudomonas rhodesiae* strain which contains the PIP-72Ba polynucleotide of SEQ ID NO: 3 encoding the PIP-72Ba polypeptide of SEQ ID NO: 4; a *Pseudomonas chlororaphis* strain which contains the PIP-72Ca polynucleotide of SEQ ID NO: 5 encoding the PIP-72Ca polypeptide of SEQ ID NO: 6; a *Pseudomonas mandelii* strain which contains the PIP-72Cb polynucleotide of SEQ ID NO: 7 encoding the PIP-72Cb polypeptide of SEQ ID NO: 8; a *Pseudomonas congelans* strain which contains the PIP-72 Da polynucleotide of SEQ ID NO: 9 encoding the PIP-72 Da polypeptide of SEQ ID NO: 10; a *Pseudomonas mandelii* strain which contains the PIP-72Db polynucleotide of SEQ ID NO: 11 encoding the PIP-72Db polypeptide of SEQ ID NO: 12; a *Pseudomonas ficuserectae* strain which contains the PIP-72Dc polynucleotide of SEQ ID NO: 13 encoding the PIP-72Dc polypeptide of SEQ ID NO: 14; a *Pseudomonas mosselii* strain which contains the PIP-72Fa polynucleotide of SEQ ID NO: 17 encoding the PIP-72Fa polypeptide of SEQ ID NO: 18; a *Pseudomonas chlororaphis* strain which contains the PIP-72Ff polynucleotide of SEQ ID NO: 27 encoding the PIP-72Ff polypeptide of SEQ ID NO: 28; a *Pseudomonas chlororaphis* strain which contains the PIP-72Gb polynucleotide of SEQ ID NO: 31 encoding the PIP-72Gb polypeptide of SEQ ID NO: 32; a *Pseudomonas chlororaphis* strain which contains the PIP-72Ab polynucleotide of SEQ ID NO: 949 encoding the PIP-72Ab polypeptide of SEQ ID NO: 927; a *Pseudomonas brassicacearum* strain which contains the PIP-72Bb polynucleotide of SEQ ID NO: 950 encoding the PIP-72Ab polypeptide of SEQ ID NO: 928; a *Pseudomonas entomophila* strain which contains the PIP-72Fh polynucleotide of SEQ ID NO: 954 encoding the PIP-72AFh polypeptide of SEQ ID NO: 932; a *Pseudomonas entomophila* strain which contains the PIP-72Fh polynucleotide of SEQ ID NO: 955 encoding the PIP-72AFh polypeptide of SEQ ID NO: 933; a *Pseudomonas chlororaphis* strain which contains the PIP-72Fj polynucleotide of SEQ ID NO: 956 encoding the PIP-72Fj polypeptide of SEQ ID NO: 934; a *Pseudomonas chlororaphis* strain which contains the PIP-72Fk polynucleotide of SEQ ID NO: 957 encoding the PIP-72Fk polypeptide of SEQ ID NO: 935; a *Burkholderia multivorans* strain which contains the PIP-72FI polynucleotide of SEQ ID NO: 958 encoding the PIP-72FI polypeptide of SEQ ID NO: 936; a *Pseudomonas chlororaphis* strain which contains the PIP-72Gg polynucleotide of SEQ ID NO: 961 encoding the PIP-72Gg polypeptide of SEQ ID NO: 939; a *Pseudomonas chlororaphis* strain which contains the PIP-72Gh polynucleotide of SEQ ID NO: 962 encoding the PIP-72Gh polypeptide of SEQ ID NO: 940; a *Pseudomonas mosselii* strain which contains the PIP-72Gi polynucleotide of SEQ ID NO: 963 encoding the PIP-72Gi polypeptide of SEQ ID NO: 941; a *Pseudomonas protegens* strain which contains the PIP-72Gk polynucleotide of SEQ ID NO: 965 encoding the PIP-72Gk polypeptide of SEQ ID NO: 943; a *Pseudomonas plecoglossicida* strain which contains the PIP-72GI polynucleotide of SEQ ID NO: 966 encoding the PIP-72GI polypeptide of SEQ ID NO: 944; and a *Pseudomonas chlororaphis* strain which contains the PIP-72Gn polynucleotide of SEQ ID NO: 968 encoding the PIP-72Gn polypeptide of SEQ ID NO: 946. These polynucleotide sequences were isolated from a *Halomonas, Photorhabdus, Xenorhabdus, Burkholderia, Paludibacterium* or *Pseudomonas* host and are thus suitable for expression of the encoded PIP-72 polypeptide in other bacterial hosts. For example, SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 27 and SEQ ID NO: 31, SEQ ID NO: 949, SEQ ID NO: 950, SEQ ID NO: 955, SEQ ID NO: 956, SEQ ID NO: 957, SEQ ID NO: 958, SEQ ID NO: 961, SEQ ID NO: 962, SEQ ID NO: 963, SEQ ID NO: 965, SEQ ID NO: 966, SEQ ID NO: 967, SEQ ID NO: 968 can be used to express PIP-72 polypeptides in bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode PIP-72 polypeptides or related proteins. Such probes can be used to identify homologous or substantially homologous polynucleotides derived from *Halomonas, Photorhabdus, Xenorhabdus, Burkholderia, Paludibacterium, Pseudomonas* or other related bacteria.

Polynucleotides that encode a PIP-72 polypeptide can also be synthesized de novo from a PIP-72 polypeptide sequence. The sequence of the polynucleotide gene can be deduced from a PIP-72 polypeptide sequence through use of the genetic code. Computer programs such as "BackTranslate" (GCG™ Package, Acclerys, Inc. San Diego, Calif.) can be used to convert a peptide sequence to the corresponding nucleotide sequence encoding the peptide. Examples of PIP-72 polypeptide sequences that can be used to obtain corresponding nucleotide encoding sequences include, but are not limited to, the PIP-72 polypeptide of sequence SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28 and SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941SEQ ID NO: 943, SEQ ID NO: 944, SEQ ID NO: 945 or SEQ ID NO: 946. Furthermore, synthetic PIP-72 polynucleotide sequences of the disclosure can be designed so that they will be expressed in plants. U.S. Pat. No. 5,500,365 describes a method for synthesizing plant genes to improve the expression level of the protein encoded by the synthesized gene. This method relates to the modification of the structural gene sequences of the exogenous transgene, to cause them to be more efficiently transcribed, processed, translated and expressed by the plant. Features of genes that are expressed well in plants include elimination of sequences that can cause undesired intron splicing or polyadenylation in the coding region of a gene transcript while retaining substantially the amino acid sequence of the toxic portion of the insecticidal protein. A similar method for obtaining enhanced expression of transgenes in monocotyledonous plants is disclosed in U.S. Pat. No. 5,689,052.

In some embodiments the nucleic acid molecule encoding a PIP-72 polypeptide is a polynucleotide having the sequence set forth in SEQ ID NO: 1; SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 27, SEQ ID NO: 31, SEQ ID NO: 949, SEQ ID NO: 950, SEQ ID NO: 955, SEQ ID NO: 956, SEQ ID NO: 957, SEQ ID NO: 958, SEQ ID NO: 961, SEQ ID NO: 962, SEQ ID NO: 963, SEQ ID NO: 965, SEQ ID NO: 966, SEQ ID NO: 967, SEQ ID NO: 968, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments a nucleic acid molecule encoding the PIP-72 polypeptide is a non-genomic nucleic acid sequence. As used herein a "non-genomic nucleic acid sequence" or "non-genomic nucleic acid molecule" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence. In some embodiments the non-genomic nucleic molecule is not the nucleic acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 27, SEQ ID NO: 31, SEQ ID NO: 949, SEQ ID NO: 950, SEQ ID NO: 955, SEQ ID NO: 956, SEQ ID NO: 957, SEQ ID NO: 958, SEQ ID NO: 961, SEQ ID NO: 962, SEQ ID NO: 963, SEQ ID NO: 965, SEQ ID NO: 966, SEQ ID NO: 967, SEQ ID NO: 968.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 2, wherein the polypeptide has pesticidal activity.

In some embodiments the non-genomic nucleic acid molecule comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 4, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 6, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 8, wherein the polypeptide has pesticidal activity.

In some embodiments the non-genomic nucleic acid molecule encodes a PIP-72 polypeptide comprising an amino acid sequence having at least 50%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 10, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 12, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 14, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 18, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 28, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 32, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 927, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 928, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 932, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 933, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 934, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 935, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 936, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 939, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 940, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 941, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 943, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 944, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 945, wherein the polypeptide has pesticidal activity.

In some embodiments the non-genomic nucleic acid molecule encodes a PIP-72 polypeptide comprising an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 946, wherein the polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946, wherein the PIP-72 polypeptide has at least one amino acid change compared to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946, and wherein the PIP-72 polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 2, wherein the PIP-72 polypeptide has at least one amino acid change compared to SEQ ID NO: 2 and the PIP-72 polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 4, wherein the PIP-72 polypeptide has at least one amino acid change compared to SEQ ID NO: 4 and the PIP-72 polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 6, wherein the PIP-72 polypeptide has at least one amino acid change compared to SEQ ID NO: 6 and the PIP-72 polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 8, wherein the PIP-72 polypeptide has at least one amino acid change compared to SEQ ID NO: 8 and the PIP-72 polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 10, wherein the PIP-72 polypeptide has at least one amino acid change compared to SEQ ID NO: 10 and the PIP-72 polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 12, wherein the PIP-72 polypeptide has at least one amino acid change compared to SEQ ID NO: 12 and the PIP-72 polypeptide has pesticidal activity.

In some embodiments the non-genomic nucleic acid molecule encodes a PIP-72 polypeptide comprising an amino acid sequence having at least 50% identity to the amino acid sequence of SEQ ID NO: 14, wherein the PIP-72 polypeptide has at least one amino acid change compared to SEQ ID NO: 14 and the PIP-72 polypeptide has pesticidal activity.

In some embodiments the non-genomic nucleic acid molecule encodes a PIP-72 polypeptide comprising an amino acid sequence having at least 60% identity to the amino acid sequence of SEQ ID NO: 18, wherein the PIP-72 polypeptide has at least one amino acid change compared to SEQ ID NO: 18 and the PIP-72 polypeptide has pesticidal activity.

In some embodiments the non-genomic nucleic acid molecule encodes a PIP-72 polypeptide comprising an amino acid sequence having at least 85% identity to the amino acid sequence of SEQ ID NO: 28, wherein the PIP-72 polypeptide has at least one amino acid change compared to SEQ ID NO: 28 and the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 32, wherein the PIP-72 polypeptide has at least one amino acid change compared to SEQ ID NO: 32, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 927, wherein the PIP-72 polypeptide has at least one amino acid change compared to SEQ ID NO: 927, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 928, wherein the PIP-72 polypeptide has at least one amino acid change compared to SEQ ID NO: 928, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 932, wherein the PIP-72 polypeptide has at least one amino acid change compared to SEQ ID NO: 932, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 933, wherein the PIP-72 polypeptide has at least one amino acid change compared to SEQ ID NO: 933, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 934, wherein the PIP-72 polypeptide has at least one amino acid change compared to SEQ ID NO: 934, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 935, wherein the PIP-72 polypeptide has at least one amino acid change compared to SEQ ID NO: 935, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 936, wherein the PIP-72 polypeptide has at least one amino acid change compared to SEQ ID NO: 936, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 939, wherein the PIP-72 polypeptide has at least one amino acid change compared to SEQ ID NO: 939, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 940, wherein the PIP-72 polypeptide has at least one amino acid change compared to SEQ ID NO: 940, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 941, wherein the PIP-72 polypeptide has at least one amino acid change compared to SEQ ID NO: 941, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 943, wherein the PIP-72 polypeptide has at least one amino acid change compared to SEQ ID NO: 943, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 944, wherein the PIP-72 polypeptide has at least one amino acid change compared to SEQ ID NO: 944, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 945, wherein the PIP-72 polypeptide has at least one amino acid change compared to SEQ ID NO: 945, and wherein the PIP-72 polypeptide has pesticidal activity.

In some embodiments the non-genomic nucleic acid molecule encodes a PIP-72 polypeptide comprising an amino acid sequence having at least 95% identity to the amino acid sequence of SEQ ID NO: 946, wherein the PIP-72 polypeptide has at least one amino acid change compared to SEQ ID NO: 946, and wherein the PIP-72 polypeptide has pesticidal activity.

In some embodiments the non-genomic nucleic acid molecule encodes a PIP-72 polypeptide comprising an amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946.

In some embodiments the non-genomic nucleic acid molecule encodes a PIP-72 polypeptide comprising an amino acid sequence of SEQ ID NO: 2 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 2.

In some embodiments the non-genomic nucleic acid molecule encodes a PIP-72 polypeptide comprising an amino acid sequence of SEQ ID NO: 4 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 4.

In some embodiments the non-genomic nucleic acid molecule encodes a PIP-72 polypeptide comprising an amino acid sequence of SEQ ID NO: 6 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 6.

In some embodiments the non-genomic nucleic acid molecule encodes a PIP-72 polypeptide comprising an amino acid sequence of SEQ ID NO: 8 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 8.

In some embodiments the non-genomic nucleic acid molecule encodes a PIP-72 polypeptide comprising an amino acid sequence of SEQ ID NO: 10 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 10.

In some embodiments the non-genomic nucleic acid molecule encodes a PIP-72 polypeptide comprising an amino acid sequence of SEQ ID NO: 12 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 12.

In some embodiments the non-genomic nucleic acid molecule encodes a PIP-72 polypeptide comprising an amino acid sequence of SEQ ID NO: 14 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 14.

In some embodiments the non-genomic nucleic acid molecule encodes a PIP-72 polypeptide comprising an amino acid sequence of SEQ ID NO: 18 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or 36 amino acid substitutions compared to the native amino acid at the corresponding position of SEQ ID NO: 18.

In some embodiments the non-genomic nucleic acid molecule encodes a PIP-72 polypeptide comprising an amino acid sequence of SEQ ID NO: 28 having 1, 2, 3, 4, 5, 6, 7, 8, 9, 10, 11, 12, 13 or 14 amino acid substitutions compared to the native amino acid at the corresponding position of SEQ ID NO: 28.

In some embodiments the non-genomic nucleic acid molecule encodes a PIP-72 polypeptide comprising an amino acid sequence of SEQ ID NO: 32 having 1, 2, 3, 4 or 5 amino acid substitutions compared to the native amino acid at the corresponding position of SEQ ID NO: 32.

In some embodiments the non-genomic nucleic acid molecule encodes a PIP-72 polypeptide comprising an amino acid sequence of SEQ ID NO: 927 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 927.

In some embodiments the non-genomic nucleic acid molecule encodes a PIP-72 polypeptide comprising an amino acid sequence of SEQ ID NO: 928 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 928.

In some embodiments the non-genomic nucleic acid molecule encodes a PIP-72 polypeptide comprising an amino acid sequence of SEQ ID NO: 932 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 932.

In some embodiments the non-genomic nucleic acid molecule encodes a PIP-72 polypeptide comprising an amino acid sequence of SEQ ID NO: 933 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 933.

In some embodiments the non-genomic nucleic acid molecule encodes a PIP-72 polypeptide comprising an amino acid sequence of SEQ ID NO: 934 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 934.

In some embodiments the non-genomic nucleic acid molecule encodes a PIP-72 polypeptide comprising an amino acid sequence of SEQ ID NO: 935 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 935.

In some embodiments the non-genomic nucleic acid molecule encodes a PIP-72 polypeptide comprising an amino acid sequence of SEQ ID NO: 936 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 936.

In some embodiments the non-genomic nucleic acid molecule encodes a PIP-72 polypeptide comprising an amino acid sequence of SEQ ID NO: 939 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 939.

In some embodiments the non-genomic nucleic acid molecule encodes a PIP-72 polypeptide comprising an amino acid sequence of SEQ ID NO: 940 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 940.

In some embodiments the non-genomic nucleic acid molecule encodes a PIP-72 polypeptide comprising an amino acid sequence of SEQ ID NO: 941 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 941.

In some embodiments the non-genomic nucleic acid molecule encodes a PIP-72 polypeptide comprising an amino acid sequence of SEQ ID NO: 943 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 943.

In some embodiments the non-genomic nucleic acid molecule encodes a PIP-72 polypeptide comprising an amino acid sequence of SEQ ID NO: 944 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 944.

In some embodiments the non-genomic nucleic acid molecule encodes a PIP-72 polypeptide comprising an amino acid sequence of SEQ ID NO: 945 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 945.

In some embodiments the non-genomic nucleic acid molecule encodes a PIP-72 polypeptide comprising an amino acid sequence of SEQ ID NO: 946 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions compared to the native amino acid at the corresponding position of SEQ ID NO: 946.

In some embodiments the non-genomic nucleic acid molecule encodes a PIP-72 polypeptide comprising an amino acid sequence of SEQ ID NO: 846 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, at positions designated by Xaa, compared to the native amino acid at the corresponding position of SEQ ID NO: 2.

In some embodiments the non-genomic nucleic acid molecule encodes a PIP-72 polypeptide comprising an amino acid sequence of SEQ ID NO: 847 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, at positions designated by Xaa, compared to the native amino acid at the corresponding position of SEQ ID NO: 2.

In some embodiments the non-genomic nucleic acid molecule encodes a PIP-72 polypeptide comprising an amino acid sequence of SEQ ID NO: 848 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, at positions designated by Xaa, compared to the native amino acid at the corresponding position of SEQ ID NO: 2.

In some embodiments the non-genomic nucleic acid molecule encodes a PIP-72 polypeptide comprising an amino acid sequence of SEQ ID NO: 849 having 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, at positions designated by Xaa, compared to the native amino acid at the corresponding position of SEQ ID NO: 2.

In some embodiments the nucleic acid molecule encodes a PIP-72 polypeptide comprising an amino acid sequence of SEQ ID NO: 846, wherein Xaa at position 2 is Gly, Ala, Cys, Asp, Glu, Ile, Lys, Leu, Asn, Arg, Ser, Thr, Val, Trp or Tyr; Xaa at position 3 is Ile or Trp; Xaa at position 4 is Thr, Ala, Asp, Glu, His, Ile, Lys, Leu, Arg, Ser, Val, Trp or Tyr; Xaa at position 5 is Val, Ala, Cys, Gly, His, Ile or Tyr; Xaa at position 6 is Thr, Ala, Cys, Phe, Gly, His, Ile, Lys, Met, Pro, Gln, Arg, Ser, Trp or Tyr; Xaa at position 7 is Asn, Ala or Val; Xaa at position 8 is Asn, Ala, Cys, Asp, Glu, Gly, His, Ile, Lys, Leu, Met, Gln, Arg, Ser, Thr or Val; Xaa at position 9 is Ser, Ala, Cys, Gly or Thr; Xaa at position 10 is Ser, Ala, Glu, Phe, Gly, His, Ile, Lys, Leu, Asn, Pro, Gln, Arg, Thr or Trp; Xaa at position 11 is Asn, Ala, Cys, Asp, Glu, Gly, His, Ile, Lys, Leu, Met, Gln, Ser, Thr, Val or Tyr; Xaa at position 12 is Pro, Ala, Cys, Asp, Glu, Gly, His, Lys, Leu, Asn, Gln, Arg, Ser, Thr, Val, Trp or Tyr; Xaa at position 13 is Ile, Asn, Gln or Val; Xaa at position 14 is Glu, Ala, Cys, Phe, His, Lys or Gln; Xaa at position 15 is Val, Ala, Cys, Ile, Met or Arg; Xaa at position 17 is Ile, Glu or Val; Xaa at position 18 is Asn or Ser; Xaa at position 19 is His, Ala, Glu, Lys, Leu, Pro, Arg, Ser or Tyr; Xaa at position 20 is Trp, Ala or Thr; Xaa at position 22 is Ser, Ala, Asp, Phe, Gly, His, Ile, Lys, Leu, Met, Asn, Pro, Gln, Arg, Thr, Val or Tyr; Xaa at position 23 is Asp, Ala, Gly, His, Lys, Met, Asn, Gln, Ser, Thr or Val; Xaa at position 24 is Gly, Asp or Phe; Xaa at position 25 is Asp, Ala, Glu, Phe, Asn or Gln; Xaa at position 26 is Thr, Glu or Pro; Xaa at position 27 is Ser, Ala, Cys, Asp, Glu, Phe, Gly, His, Asn, Gln, Arg or Thr; Xaa at position 28 is Phe, Pro, Trp or Tyr; Xaa at position 29 is Phe, Ala, Cys, Ile, Leu, Gln, Arg, Trp or Tyr; Xaa at position 30 is Ser, Ala, Cys, Asp, Glu, Phe, Gly, His, Lys, Leu, Met, Asn, Pro, Gln, Arg, Thr, Val, Trp or Tyr; Xaa at position 31 is Val, Ile or Leu; Xaa at position 32 is Gly, Ala, Asp, Glu, Phe, His, Lys, Leu, Met, Asn, Pro, Gln, Arg, Ser, Thr, Val, Trp or Tyr; Xaa at position 33 is Asn, Ala, Cys, Asp, Glu, Phe, Gly, His, Ile, Lys, Leu, Pro, Gln, Arg, Ser, Thr, Val or Tyr; Xaa at position 34 is Gly, Glu, Phe, His, Lys, Leu, Met, Asn, Gln, Arg, Ser, Thr or Tyr; Xaa at position 35 is Lys, Ala, Cys, Asp, Gly, His, Ile, Leu, Met, Asn, Gln, Arg, Ser, Thr or Val; Xaa at position 36 is Gln, Ala, Cys, Glu, Gly, His, Ile, Lys, Leu, Asn, Pro, Arg, Ser, Thr or Val; Xaa at position 37 is Glu, Ala, Cys, Asp, Phe, Gly, Ile, Lys, Leu, Met, Asn, Ser, Thr or Val; Xaa at position 38 is Thr, Ala, Cys, Asp, Glu, Phe, Gly, His, Ile, Leu, Met, Asn, Gln, Arg, Ser, Val, Trp or Tyr; Xaa at position 39 is Trp or Phe; Xaa at position 40 is Asp, Ala, Cys, Glu, Phe, Gly, His, Ile, Lys, Leu, Met, Asn, Gln, Arg, Ser, Thr, Val, Trp or Tyr; Xaa at position 42 is Ser, Ala, Cys, Asp, Glu, Phe, Gly, Ile, Lys, Leu, Met, Asn, Gln, Arg, Thr, Val, Trp or Tyr; Xaa at position 44 is Ser, Ala, Asp, Glu, Gly, Leu, Met, Asn, Pro, Gln, Thr, Val or Tyr; Xaa at position 45 is Arg, Lys or Ser; Xaa at position 46 is Gly, Ala or Gln; Xaa at position 47 is Phe, Cys, Val or Tyr; Xaa at position 48 is Val, Ile or Leu; Xaa at position 49 is Leu, Cys, Phe, Met, Arg or Tyr; Xaa at position 50 is Ser, Ala, Cys, Asp, Ile, Met, Pro, Gln, Thr or Val; Xaa at position 51 is Leu, Ala, Cys, Met or Val; Xaa at position 52 is Lys, Cys, Phe, His, Ile, Leu, Met, Asn, Arg, Ser, Thr, Trp or Tyr; Xaa at position 53 is Lys, Ala, Cys, Asp, Glu, Phe, His, Ile, Leu, Met, Asn, Gln, Arg, Ser, Thr, Val or Tyr; Xaa at position 54 is Asn, Cys, Asp, Glu, Phe, Gly, Lys, Met, Gln, Arg, Ser or Trp; Xaa at position 56 is Ala, Gly, Leu, Asn, Pro, Gln, Arg, Ser or Thr; Xaa at position 57 is Gln, Glu, Leu, Met, Ser or Thr; Xaa at position 58 is His, Ala, Asp, Phe, Leu, Met, Asn, Arg, Trp or Tyr; Xaa at position 60 is Tyr, Glu or Phe; Xaa at position 63 is Gln, Cys, Gly, Ile, Leu, Met, Asn, Thr, Val or Tyr; Xaa at position 64 is Ala, Phe, Gly, His, Arg, Ser or Tyr; Xaa at position 65 is Ser, Ala, Cys, Asp, Glu, Phe, Gly, His, Ile, Leu, Asn, Thr or Val; Xaa at position 66 is Ser, Ala or Gly; Xaa at position 67 is Lys, Ala, Cys, Asp, Phe, His, Ile, Leu, Met, Asn, Gln, Arg, Ser, Thr, Val, Trp or Tyr; Xaa at position 68 is Ile Asp, Leu or Val; Xaa at position 69 is Glu, Ala, Cys, Asp, Phe, His, Ile, Leu, Met, Gln, Arg, Ser, Thr, Val or Tyr; Xaa at position 70 is Val, Cys or Ile; Xaa at position 71 is Asp, Ala, Cys, Gly, His, Ile, Leu, Met, Asn, Ser, Thr, Val or Tyr; Xaa at position 72 is Asn, Ala, Cys, Asp, Glu, Gly, Lys, Met, Pro, Gln, Arg, Ser, Thr, Val or Trp; Xaa at position 73 is Asn, Ala, Cys, Asp, Phe, Gly, His, Ile, Leu, Ser, Thr, Val or Tyr; Xaa at position 74 is Ala, Cys, Asp, Phe, Gly, His, Ile, Leu, Asn, Gln, Arg, Ser, Thr, Val or Tyr; Xaa at position 75 is Val, Cys, Ile or Leu; Xaa at position 76 is Lys, Ala, Cys, Phe, His, Ile, Leu, Gln, Arg, Ser, Thr, Val, Trp or Tyr; Xaa at position 77 is Asp Tyr; Xaa at position 78 is Gln, Ala, Cys, Asp, Phe, Gly, His, Ile, Leu, Met, Asn, Arg, Ser, Thr, Val or Tyr; Xaa at position 79 is Gly, Arg, Ala, Cys, Asp, Glu, Phe, His, Lys, Leu, Asn, Gln, Arg, Ser, Thr, Trp or Tyr; Xaa at position 80 is Arg, Ala, Cys, Asp, Phe, Gly, His, Ile, Leu, Asn, Ser, Thr, Val or Tyr; Xaa at position 81 is Leu, Ala, Cys, Asp, Phe, Gly, His, Ile, Asn, Pro, Arg, Ser, Thr or Val; Xaa at position 82 is Ile, Ala, Leu, Met, Arg or Val; Xaa at position 83 is Glu, Ala, Cys, Asp, Phe, Gly, His, Ile, Lys, Leu, Asn, Pro, Arg, Ser, Thr, Val or Tyr; Xaa at position 84 is Pro, Ala, Cys, Glu, Ile, Ser, Val, Trp or Tyr; Xaa at position 85 is Leu, Cys, Gly or Val; and Xaa at position 86 is Ser, Ala, Ile, Thr or Val, and wherein 1 to 14 amino acids are optionally deleted from the N-terminus and/or C-terminus of the PIP-72 polypeptide.

In some embodiments the nucleic acid molecule encodes a PIP-72 polypeptide comprising an amino acid sequence of SEQ ID NO: 847, wherein Xaa at position 2 is Gly, Lys or Ala; Xaa at position 3 is Ile or Leu; Xaa at position 4 is Thr or Ser; Xaa at position 5 is Val or Ile; Xaa at position 6 is Thr or Lys; Xaa at position 8 is Asn, Lys, Gly or Ser; Xaa at position 9 is Ser or Ala; Xaa at position 11 is Asn, Lys, His or Thr; Xaa at position 12 is Pro, Thr, Lys or Ser; Xaa at position 13 is Ile or Val; Xaa at position 14 is Glu or Asp; Xaa at position 15 is Val, Ala or Ile; Xaa at position 16 is Ala or Ser; Xaa at position 17 is Ile or Val; Xaa at position 18 is Asn or Ser; Xaa at position 19 is His, Lys, Arg, Gln or Ala; Xaa at position 21 is Gly or Arg; Xaa at position 22 is Ser, Lys, Asn, Asp or Thr; Xaa at position 25 is Asp or Asn; Xaa at position 26 is Thr or Asp; Xaa at position 27 is Ser, Thr, Asn or Lys; Xaa at position 28 is Phe, Tyr or Pro; Xaa at position 29 is Phe or Tyr; Xaa at position 30 is Ser, Gly or Lys; Xaa at position 31 is Val, Ile or Met; Xaa at position 32 is Gly, Ala or Asp; Xaa at position 33 is Asn, Ser, Gln or Pro; Xaa at position 35 is Lys, Glu or Ser; Xaa at position 36 is Gln, Asn or Ser; Xaa at position 37 is Glu or Asp; Xaa at position 38 is Thr or Ser; Xaa at position 42 is Ser or Asn; Xaa at position 44 is Ser, Asp, Ala or Leu; Xaa at position 47 is Phe or Tyr; Xaa at position 48 is Leu or Met; Xaa at position 49 is Leu or Met; Xaa at position 50 is Ser, Ala or Tyr; Xaa at position 51 is Leu or Val; Xaa at position 52 is Lys or Gln; Xaa at position 53 is Lys, Arg, Met or Leu; Xaa at position 54 is Asn, Lys or Gly; Xaa at position 55 is Gly or Ser; Xaa at position 56 is Ala, Thr, Gln or Ser; Xaa at position 57 is Gln, Val or Ala; Xaa at position 58 is His, Ala, Lys, Tyr or Thr; Xaa at position 59 is Pro or Thr; Xaa at position 62 is Val or Ile; Xaa at position 63 is Gln, Ser or Leu; Xaa at position 64 is Ala, Gln or Ser; Xaa at position 65 is Ser or Thr; Xaa at position 67 is Lys, Gln, Arg or Asn; Xaa at position 69 is Glu, Lys or Val; Xaa at position 70 is Val or Ile; Xaa at position 71 is Asp, Glu or Tyr; Xaa at position 72 is Asn, His, Ser or Asp; Xaa at position 73 is Asn, Ser or Asp; Xaa at position 74 is Ala, Thr, Met, Ile or Lys; Xaa at position 76 is Lys or Thr; Xaa at position 78 is Gln, His or Ser; Xaa at position 80 is Arg, Glu or Gln; Xaa at position 81 is Leu, Pro, Ala or Thr; Xaa at position 82 is Ile or Leu; Xaa at position 83 is Glu, His, Asn, Gln or Leu; Xaa at position 85 is Leu, Val or Ala; and Xaa at position 86 is Ser, Ala, Tyr or Asn, and wherein, 1 to 14 amino acids are optionally deleted from the N-terminus and/or C-terminus of the PIP-72 polypeptide and/or an amino acid is inserted between residue 24 and 25 relative to SEQ ID NO: 847.

In some embodiments the nucleic acid molecule encodes a PIP-72 polypeptide comprising an amino acid sequence of SEQ ID NO: 848, wherein Xaa at position 2 is Gly, Lys, Ala or Arg; Xaa at position 3 is Ile, Leu or Val; Xaa at position 4 is Thr or Ser; Xaa at position 5 is Val, Ile or Leu; Xaa at position 6 is Thr, Lys, Ser or Arg; Xaa at position 8 is Asn, Lys, Gly, Ser, Gln, Arg, Thr or Ala; Xaa at position 9 is Ser, Ala or Thr; Xaa at position 11 is Asn, Lys, Thr, Gln, Arg, His or Ser; Xaa at position 12 is Pro, Thr, Lys, Ser or Arg; Xaa at position 13 is Ile, Val or Leu; Xaa at position 14 is Glu or Asp; Xaa at position 15 is Val, Ala, Ile or Leu; Xaa at position 16 is Ala or Ser; Xaa at position 17 is Ile, Val or Leu; Xaa at position 18 is Asn, Ser, Gln or Thr; Xaa at position 19 is His, Lys, Ala, Gln, Asn or Arg; Xaa at position 21 is Gly, Arg or Lys; Xaa at position 22 is Ser, Lys, Asn, Thr, Arg, Asp, Glu or Gln; Xaa at position 25 is Asp, Asn, Glu or Gln; Xaa at position 26 is Thr, Asp, Ser or Glu; Xaa at position 27 is Ser, Thr, Lys, Asn, Gln or Arg; Xaa at position 28 is Phe, Tyr, Pro or Trp; Xaa at position 29 is Phe, Tyr or Trp; Xaa at position 30 is Ser, Gly, Lys, Thr or Arg; Xaa at position 31 is Val, Ile, Met or Leu; Xaa at position 32 is Gly, Ala, Asp or Glu; Xaa at position 33 is Asn, Ser, Gln, Pro or Thr; Xaa at position 35 is Lys, Glu, Ser, Arg or Thr; Xaa at position 36 is Gln, Ser, Asn or Thr; Xaa at position 37 is Glu or Asp; Xaa at position 38 is Thr or Ser; Xaa at position 42 is Ser, Asn, Thr or Gln; Xaa at position 44 is Ser, Asp, Ala, Leu, Thr, Glu, Ile or Val; Xaa at position 47 is Phe, Tyr or Trp; Xaa at position 48 is Leu, Met, Ile or Val; Xaa at position 49 is Leu, Met, Ile or Val; Xaa at position 50 is Ser, Ala, Tyr or Thr; Xaa at position 51 is Leu, Val or Ile; Xaa at position 52 is Lys, Gln, Arg or Asn; Xaa at position 53 is Lys, Arg, Met, Leu, Ile or Val; Xaa at position 54 is Asn, Lys, Gly, Gln or Arg; Xaa at position 55 is Gly, Ser or Thr; Xaa at position 56 is Ala, Thr, Gln, Ser or Asn; Xaa at position 57 is Gln, Val, Ala, Asn, Leu or Ile; Xaa at position 58 is His, Ala, Lys, Tyr or Thr; Xaa at position 59 is Pro, Thr or Ser; Xaa at position 62 is Val, Ile or Leu; Xaa at position 63 is Gln, Ser, Leu, Asn, Thr, Ile or Val; Xaa at position 64 is Ala, Gln, Ser, Asn or Thr; Xaa at position 65 is Ser or Thr; Xaa at position 67 is Lys, Gln, Asn or Arg; Xaa at position 69 is Glu, Val, Asp, Lys, Arg, Ile or Leu; Xaa at position 70 is Val, Ile or Leu; Xaa at position 71 is Asp, Glu, Tyr or Trp; Xaa at position 72 is Asn, His, Ser, Asp, Gln, Thr or Glu; Xaa at position 73 is Asn, Ser, Asp, Gln, Thr or Glu; Xaa at position 74 is Ala, Thr, Met, Ile, Lys, Ser, Leu, Val or Arg; Xaa at position 76 is Lys, Thr, Arg or Ser; Xaa at position 78 is Gln, His, Ser, Asn or Thr; Xaa at position 80 is Arg, Glu, Gln, Lys, Asp or Asn; Xaa at position 81 is Leu, Pro, Thr, Ile, Val, Ala or Ser; Xaa at position 82 is Ile, Leu or Val; Xaa at position 83 is Glu, His, Asn, Leu, Gln, Ile or Val; Xaa at position 85 is Leu, Val or Ala; and Xaa at position 86 is Ser, Ala, Tyr, Asn or Thr, and wherein, 1 to 14 amino acids are optionally deleted from the N-terminus and/or C-terminus of the PIP-72 polypeptide and/or an amino acid is inserted between residue 24 and 25 relative to SEQ ID NO: 848.

In some embodiments the nucleic acid molecule encodes a PIP-72 polypeptide comprising an amino acid sequence of SEQ ID NO: 849, wherein Xaa at position 2 is Gly, Ala, Cys, Asp, Glu, Ile, Lys, Leu, Asn, Arg, Ser, Thr, Val, Trp or Tyr; Xaa at position 3 is Ile, Leu, Val or Trp; Xaa at position 4 is Thr, Ala, Asp, Glu, His, Ile, Lys, Leu, Arg, Ser, Val, Trp or Tyr; Xaa at position 5 is Val, Ala, Cys, Gly, His, Ile, Leu or Tyr; Xaa at position 6 is Thr, Ala, Cys, Phe, Gly, His, Ile, Lys, Met, Pro, Gln, Arg, Ser, Trp or Tyr; Xaa at position 7 is Asn, Ala or Val; Xaa at position 8 is Asn, Lys, Gly, Ser, Gln, Arg, Thr, Ala, Cys, Asp, Glu, His, Ile, Leu, Met or Val; Xaa at position 9 is Ser, Ala, Cys, Gly or Thr; Xaa at position 11 is Asn, Lys, Thr, Gln, Arg, Ser, Ala, Cys, Asp, Glu, Gly, His, Ile, Leu, Met, Val or Tyr; Xaa at position 12 is Pro, Thr, Lys, Ser, Arg, Ala, Cys, Asp, Glu, Gly, His, Leu, Asn, Gln, Arg, Val, Trp or Tyr; Xaa at position 13 is Ile, Asn, Gln, Leu or Val; Xaa at position 14 is Glu, Ala, Cys, Phe, His, Lys, Asp or Gln; Xaa at position 15 is Val, Ala, Ile, Leu, Cys, Met or Arg; Xaa at position 16 is Ala or Ser; Xaa at position 17 is Ile, Glu, Leu or Val; Xaa at position 18 is Asn, Gln, Thr or Ser; Xaa at position 19 is His, Lys, Ala, Arg, Glu, Leu, Pro, Ser or Tyr; Xaa at position 20 is Trp, Ala or Thr; Xaa at position 21 is Gly, Arg or Lys; Xaa at position 22 is Ser, Ala, Asp, Phe, Gly, His, Ile, Lys, Leu, Met, Asn, Pro, Gln, Arg, Thr, Val or Tyr; Xaa at position 23 is Asp, Ala, Gly, His, Lys, Met, Asn, Gln, Ser, Thr or Val; Xaa at position 24 is Gly, Asp or Phe; Xaa at position 25 is Asp, Ala, Glu, Phe, Asn or Gln; Xaa at position 26 is Thr, Glu, Asp, Ser or Pro; Xaa at position 27 is Ser, Thr, Lys, Arg, Ala, Cys, Asp, Glu, Phe, Gly, His, Asn or Gln; Xaa at position 28 is Phe, Tyr, Pro or Trp; Xaa at position 29 is Phe, Ala, Cys, Ile, Leu, Gln, Arg, Trp or Tyr; Xaa at position 30 is Ser, Gly, Lys, Thr, Arg, Ala, Cys, Asp, Glu, Phe, His, Leu, Met, Asn, Pro, Gln, Val, Trp or Tyr; Xaa at position 31 is Val, Ile, Met or Leu; Xaa at position 32 is Gly, Ala, Asp, Glu, Phe, His, Lys, Leu, Met, Asn, Pro, Gln, Arg, Ser, Thr, Val, Trp or Tyr; Xaa at position 33 is Asn, Ser, Gln, Pro, Thr, Ala, Cys, Asp, Glu, Phe, Gly, His, Ile, Lys, Leu, Arg, Val or Tyr; Xaa at position 34 is Gly, Glu, Phe, His, Lys, Leu, Met, Asn, Gln, Arg, Ser, Thr or Tyr; Xaa at position 35 is Lys, Glu, Ala, Cys, Asp, Gly, His, Ile, Leu, Met, Asn, Gln, Arg, Ser, Thr or Val; Xaa at position 36 is Gln, Ala, Cys, Glu, Gly, His, Ile, Lys, Leu, Asn, Pro, Arg, Ser, Thr or Val; Xaa at position 37 is Glu, Asp, Ala, Cys, Phe, Gly, Ile, Lys, Leu, Met, Asn, Ser, Thr or Val; Xaa at position 38 is Thr, Ser, Ala, Cys, Asp, Glu, Phe, Gly, His, Ile, Leu, Met, Asn, Gln, Arg, Val, Trp or Tyr; Xaa at position 39 is Trp or Phe; Xaa at position 40 is Asp, Ala, Cys, Glu, Phe, Gly, His, Ile, Lys, Leu, Met, Asn, Gln, Arg, Ser, Thr, Val, Trp or Tyr; Xaa at position 42 is Ser, Asn, Thr, Ala, Cys, Asp, Glu, Phe, Gly, Ile, Lys, Leu, Met, Arg, Val, Trp, Tyr or Gln; Xaa at position 44 is Ser, Asp, Ala, Leu, Thr, Glu, Ile, Ala, Gly, Leu, Met, Asn, Pro, Gln, Val, Tyr or Val; Xaa at position 45 is Arg, Lys or Ser; Xaa at position 46 is Gly, Ala or Gln; Xaa at position 47 is Phe, Tyr Cys, Val or Trp; Xaa at position 48 is Leu, Met, Ile, Cys, Phe, Met, Arg, Tyr or Val; Xaa at position 49 is Leu, Met, Ile or Val; Xaa at position 50 is Ser, Ala, Tyr, Cys, Asp, Ile, Met, Pro, Gln, Val or Thr; Xaa at position 51 is Leu, Val, Ala, Cys, Met or Ile; Xaa at position 52 is Lys, Cys, Phe, His, Ile, Leu, Met, Asn, Arg, Ser, Thr, Gln, Trp or Tyr; Xaa at position 53 is Lys, Arg, Met, Leu, Ile, Ala, Cys, Asp, Glu, Phe, His, Asn, Gln, Ser, Thr, Tyr or Val; Xaa at position 54 is Asn, Cys, Asp, Glu, Phe, Gly, Lys, Met, Gln, Arg, Ser or Trp; Xaa at position 55 is Gly, Ser or Thr; Xaa at position 56 is Ala, Thr, Gln, Ser, Gly, Leu, Pro, Arg or Asn; Xaa at position 57 is Gln, Glu, Leu, Met, Ser, Val, Ala, Asn, Ile or Thr; Xaa at position 58 is His, Ala, Lys, Asp, Phe, Leu, Met, Asn, Arg, Trp, Tyr or Thr; Xaa at position 59 is Pro, Thr or Ser; Xaa at position 60 is Tyr, Glu or Phe; Xaa at position 62 is Val, Ile or Leu; Xaa at position 63 is Gln, Ser, Cys, Gly, Ile, Leu, Met, Asn, Thr, Val or Tyr; Xaa at position 64 is Ala, Gln, Asn, Phe, Gly, His, Arg, Ser or Tyr; Xaa at position 65 is Ser, Ala, Cys, Asp, Glu, Phe, Gly, His, Ile, Leu, Asn, Val or Thr; Xaa at position 66 is Ser, Ala or Gly; Xaa at position 67 is Lys, Gln, Asn or Arg; Xaa at position 67 is Lys, Ala, Cys, Asp, Phe, His, Ile, Leu, Met, Asn, Gln, Arg, Ser, Thr, Val, Trp or Tyr; Xaa at position 68 is Ile Asp, Leu or Val; Xaa at position 69 is Glu, Ala, Cys, Asp, Phe, His, Ile, Leu, Met, Gln, Arg, Ser, Thr, Val or Tyr; Xaa at position 70 is Val, Ile, Cys or Leu; Xaa at position 71 is Asp, Glu, Tyr, Ala, Cys, Gly, His, Ile, Leu, Met, Asn, Ser, Thr, Val or Trp; Xaa at position 72 is Asn, Ala, Cys, Asp, Glu, Gly, Lys, Met, Pro, Gln, Arg, Ser, Thr, Val, His or Trp; Xaa at position 73 is Asn, Ser, Asp, Gln, Thr, Ala, Cys, Phe, Gly, His, Ile, Leu, Val, Tyr or Glu; Xaa at position 74 is Ala, Thr, Met, Ile, Lys, Ser, Leu, Val, Cys, Asp, Phe, Gly, His, Asn, Gln, Tyr or Arg; Xaa at position 75 is Val, Cys, Ile or Leu; Xaa at position 76 is Lys, Ala, Cys, Phe, His, Ile, Leu, Gln, Arg, Ser, Thr, Val, Trp or Tyr; Xaa at position 77 is Asp Tyr; Xaa at position 78 is Gln, His, Ser, Asn, Ala, Cys, Asp, Phe, Gly, Ile, Leu, Met, Asn, Arg, Val, Tyr or Thr; Xaa at position 79 is Gly, Arg, Ala, Cys, Asp, Glu, Phe, His, Lys, Leu, Asn, Gln, Arg, Ser, Thr, Trp or Tyr; Xaa at position 80 is Arg, Glu, Gln, Lys, Asp, Ala, Cys, Phe, Gly, His, Ile, Leu, Ser, Thr, Val, Tyr or Asn; Xaa at position 81 is Leu, Pro, Thr, Ile, Val, Ala, Cys, Asp, Phe, Gly, His or Ser; Xaa at position 82 is Ile, Ala, Leu, Met, Arg and Val; Xaa at position 83 is Glu, His, Asn, Leu, Gln, Ile, Ala, Cys, Asp, Phe, Gly, Lys, Pro, Arg, Ser, Thr, Tyr or Val; Xaa at position 84 is Pro, Ala, Cys, Glu, Ile, Ser, Val, Trp or Tyr; Xaa at position 85 is Leu, Val, Cys, Gly or Ala; and Xaa at position 86 is Ser, Ala, Tyr, Asn, Ile, Val or Thr, and wherein, 1 to 14 amino acids are optionally deleted from the N-terminus and/or C-terminus of the PIP-72 polypeptide and/or an amino acid is inserted between residue 24 and 25 relative to SEQ ID NO: 849.

In some embodiments the nucleic acid molecules encode a PIP-72 polypeptide comprising an amino acid motif as represented by positions 37-51 of SEQ ID NO: 846, SEQ ID NO: 847, SEQ ID NO: 848 or SEQ ID NO: 849.

In some embodiments the nucleic acid molecules encode a PIP-72 polypeptide comprising an amino acid sequence having at least 50% identity to the amino acid sequence set forth in SEQ ID NO: 2

In some embodiments exemplary nucleic acid molecules encode a PIP-72 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946, as well as amino acid substitutions deletions, insertions and fragments thereof and combinations thereof.

In some embodiments the nucleic acid molecules encode a PIP-72 polypeptide of Table 14, Table 17, Table 20, Table 23, Table 24, Table 26, Table 28, and/or Table 29, combinations of the amino acid substitutions thereof, and deletions and/or insertions thereof.

Also provided are nucleic acid molecules that encode transcription and/or translation products that are subsequently spliced to ultimately produce functional PIP-72 polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate a PIP-72 polypeptide encoding sequence. An example of trans splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments the polynucleotides do not directly encode a full-length PIP-72 polypeptide, but rather encode a fragment or fragments of a PIP-72 polypeptide. These polynucleotides can be used to express a functional PIP-72 polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding PIP-72 polypeptides are also encompassed by the embodiments. "Fragment" as used herein refers to a portion of the nucleic acid sequence encoding a PIP-72 polypeptide. A fragment of a nucleic acid sequence may encode a biologically active portion of a PIP-72 polypeptide or it may be a fragment that can be used as a hybridization probe or PCR primer using methods disclosed below. Nucleic acid molecules that are fragments of a nucleic acid sequence encoding a PIP-72 polypeptide comprise at least about 130, 140, 150, 160, 170, 180, 190, 200, 210, 220, 230, 240, 250 or 260, contiguous nucleotides or up to the number of nucleotides present in a full-length nucleic acid sequence encoding a PIP-72 polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the PIP-72 polypeptide and, hence, retain insecticidal activity. "Retains PIP-72 activity" is used herein to refer to a polypeptide having at least about 10%, at least about 30%, at least about 50%, at least about 70%, 80%, 90%, 95% or higher of the insecticidal activity of the full-length PIP-72Aa polypeptide of SEQ ID NO: 2. In one embodiment, the insecticidal activity is Lepidoptera activity. In one embodiment, the insecticidal activity is against a Coleopteran species. In one embodiment, the insecticidal activity is against a *Diabrotica* species. In one embodiment, the insecticidal activity is against one or more insect pests of the corn rootworm complex: Western corn rootworm, *Diabrotica virgifera virgifera*; northern corn rootworm, *D. barberi*: Southern corn rootworm or spotted cucumber beetle; *Diabrotica* undecimpunctata howardi, and the Mexican corn rootworm, *D. virgifera zeae*. In one embodiment, the insecticidal activity is against Western corn rootworm, *Diabrotica virgifera virgifera*.

In some embodiments a fragment of a nucleic acid sequence encoding a PIP-72 polypeptide encoding a biologically active portion of a protein will encode at least about 15, 20, 30, 40, 50, 60, 70, 75, 76, 77, 78, 79, 80, 81, 82, 83, 84 or 85, contiguous amino acids or up to the total number of amino acids present in a full-length PIP-72 polypeptide of the embodiments. In some embodiments, the fragment is an N-terminal and/or a C-terminal truncation of at least about 1, 2, 3, 4, 5, 6, 7, 8, 9, 10, 11, 12, 13, 14 or more amino acids from the N-terminus and/or C-terminus relative to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946 or variants thereof, e.g., by proteolysis, insertion of a start codon, deletion of the codons encoding the deleted amino acids with the concomitant insertion of a stop codon or by insertion of a stop codon in the coding sequence. In some embodiments, the fragments encompassed herein result from the removal of the N-terminal 1, 2, 3, 4, 5, 6, 7, 8, 9, 10, 11, 12, 13 or 14 or more amino acids from the N-terminus relative to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946 or variants thereof, e.g., by proteolysis or by insertion of a start codon in the coding sequence. In some embodiments, the frag- ments encompassed herein result from the removal of the N-terminal 1, 2, 3, 4, 5, 6, 7, 8, 9, 10, 11, 12, 13, 14 amino acids relative to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28 or SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946 or variants thereof, e.g., by proteolysis or by insertion of a start codon in the coding sequence.

In some embodiments a PIP-72 polypeptide is encoded by a nucleic acid sequence sufficiently homologous to the nucleic acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 27, SEQ ID NO: 31, SEQ ID NO: 949, SEQ ID NO: 950, SEQ ID NO: 954, SEQ ID NO: 955, SEQ ID NO: 956, SEQ ID NO: 957, SEQ ID NO: 958, SEQ ID NO: 961, SEQ ID NO: 962, SEQ ID NO: 963, SEQ ID NO: 965, SEQ ID NO: 966, SEQ ID NO: 967 or SEQ ID NO: 968. "Sufficiently homologous" is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by taking into account codon degeneracy, amino acid similarity, reading frame positioning, and the like. In some embodiments the sequence homology is against the full length sequence of the polynucleotide encoding a PIP-72 polypeptide or against the full length sequence of a PIP-72 polypeptide. In some embodiments the PIP-72 polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28 or SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946. In some embodiments the sequence identity is against the full length sequence of the polynucleotide encoding a PIP-72 polypeptide or against the full length sequence of a PIP-72 polypeptide. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two amino acid sequences or of two nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of one of SEQ ID NO: 1, SEQ ID NO: 2). The percent identity between two sequences can be determined using techniques similar to those described below, with or without allowing gaps. In calculating percent identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, (1990) *Proc. Natl. Acad. Sci. USA* 87:2264, modified as in Karlin and Altschul, (1993) *Proc. Natl. Acad. Sci. USA* 90:5873-5877. Such an algorithm is incorporated into the BLASTN and BLASTX programs of Altschul, et al., (1990) *J. Mol. Biol.* 215:403. BLAST nucleotide searches can be performed with the BLASTN program, score=100, wordlength=12, to obtain nucleic acid sequences homologous to pesticidal nucleic acid molecules of the embodiments. BLAST protein searches can be performed with the BLASTX program, score=50, wordlength=3, to obtain amino acid sequences homologous to pesticidal protein molecules of the embodiments. To obtain gapped alignments for comparison purposes, Gapped BLAST (in BLAST 2.0) can be utilized as described in Altschul, et al., (1997) *Nucleic Acids Res.* 25:3389. Alternatively, PSI-Blast can be used to perform an iterated search that detects distant relationships between molecules. See, Altschul, et al., (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins, et al., (1994) *Nucleic Acids Res.* 22:4673-4680). ClustalW compares sequences and aligns the entirety of the amino acid or DNA sequence, and thus can provide data about the sequence conservation of the entire amino acid sequence. The ClustalW algorithm is used in several commercially available DNA/amino acid analysis software packages, such as the ALIGNX® module of the Vector NTI® Program Suite (Invitrogen Corporation, Carlsbad, Calif.). After alignment of amino acid sequences with ClustalW, the percent amino acid identity can be assessed. A non-limiting example of a software program useful for analysis of ClustalW alignments is GENEDOC™. GENEDOC™ (Karl Nicholas) allows assessment of amino acid (or DNA) similarity and identity between multiple proteins. Another non-limiting example of a mathematical algorithm utilized for the comparison of sequences is the algorithm of Myers and Miller, (1988) *CABIOS* 4:11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12, and a gap penalty of 4 can be used.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

The embodiments also encompass nucleic acid molecules encoding PIP-72 polypeptide variants. "Variants" of the PIP-72 polypeptide encoding nucleic acid sequences include those sequences that encode the PIP-72 polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the PIP-72 polypeptides disclosed as discussed below.

The present disclosure provides isolated or recombinant polynucleotides that encode any of the PIP-72 polypeptides disclosed herein. Those having ordinary skill in the art will readily appreciate that due to the degeneracy of the genetic code, a multitude of nucleotide sequences encoding PIP-72 polypeptides of the present disclosure exist. Table 1 is a codon table that provides the synonymous codons for each amino acid. For example, the codons AGA, AGG, CGA, CGC, CGG, and CGU all encode the amino acid arginine. Thus, at every position in the nucleic acids of the disclosure where an arginine is specified by a codon, the codon can be altered to any of the corresponding codons described above without altering the encoded polypeptide. It is understood that U in an RNA sequence corresponds to T in a DNA sequence.

TABLE 1

| Alanine | Ala | GCA GCC GCG GCU |
|---|---|---|
| Cysteine | Cys | UGC UGU |
| Aspartic acid | Asp | GAC GAU |
| Glutamic acid | Glu | GAA GAG |
| Phenylalanine | Phe | UUC UUU |
| Glycine | Gly | GGA GGC GGG GGU |
| Histidine | His | CAC CAU |
| Isoleucine | Ile | AUA AUC AUU |
| Lysine | Lys | AAA AAG |
| Leucine | Leu | UUA UUG CUA CUC CUG CUU |
| Methionine | Met | AUG |
| Asparagine | Asn | AAC AAU |
| Proline | Pro | CCA CCC CCG CCU |
| Glutamine | Gln | CAA CAG |
| Arginine | Arg | AGA AGG CGA CGC CGG CGU |
| Serine | Ser | AGC AGU UCA UCC UCG UCU |
| Threonine | Thr | ACA ACC ACG ACU |

TABLE 1-continued

| | | |
|---|---|---|
| Valine | Val | GUA GUC GUG UU |
| Tryptophan | Trp | UGG |
| Tyrosine | Tyr | UAC UAU |

The skilled artisan will further appreciate that changes can be introduced by mutation of the nucleic acid sequences thereby leading to changes in the amino acid sequence of the encoded PIP-72 polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produces by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene*, 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond* A 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA*, 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

Additional details regarding various diversity generating methods can be found in the following US Patents, PCT Publications and Applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from other organisms, particularly other bacteria, particularly a *Pseudomonas* species and more particularly a *Pseudomonas putida*, a *Pseudomonas fulva* or a *Pseudomonas chlororaphis* strain. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential PIP-72 polypeptides from bacterial collections, the bacterial cell lysates can be screened with antibodies generated against a PIP-72 polypeptide using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of PIP-72 polypeptides using protocols in the literatures (Scott Patterson, (1998), 10.22, 1-24, Current Protocol in Molecular Biology published by John Wiley & Son Inc). Specifically, LC-MS/MS based protein identification method is used to associate the MS data of given cell lysate or desired molecular weight enriched samples (excised from SDS-PAGE gel of relevant molecular weight bands to PIP-72) with sequence information of PIP-72 (e.g., SEQ ID NO: 2)) and its homologs. Any match in peptide sequences indicates the potential of having the homologs in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known PIP-72 polypeptide-encoding nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding a PIP-72 polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding a PIP-72 polypeptide, disclosed herein or one or more portions thereof may be used as a probe capable of specifically hybridizing to corresponding nucleic acid sequences encoding PIP-72 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the Tm can be approximated from the equation of Meinkoth and Wahl, (1984) *Anal. Biochem.* 138:267-284: Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization, and/or wash conditions can be adjusted to hybridize to sequences of the desired identity. For example, if sequences with 90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3 or 4° C. lower than the thermal melting point (Tm); moderately stringent conditions can utilize a hybridization and/or wash at 6, 7, 8, 9 or 10° C. lower than the thermal melting point (Tm); low stringency conditions can utilize a hybridization and/or wash at 11, 12, 13, 14, 15 or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, (1993) Laboratory Techniques in Biochemistry and Molecular Biology-Hybridization with Nucleic Acid Probes, Part I, Chapter 2 (Elsevier, N.Y.); and Ausubel, et al., eds. (1995) Current Protocols in Molecular Biology, Chapter 2 (Greene Publishing and Wiley-Interscience, New York). See, Sambrook, et al., (1989) Molecular Cloning: A Laboratory Manual (2d ed., Cold Spring Harbor Laboratory Press, Cold Spring Harbor, N.Y.).

In some embodiments nucleic acid molecules are provided that encode a polypeptide comprising an amino acid sequence having at least 75%, at least 80%, at least 85%, at least 90%, at least 95% or greater sequence identity to the amino acid sequence set forth in SEQ ID NO: 20, SEQ ID NO: 22, SEQ ID NO: 24, SEQ I NO: 26, SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948 wherein the polypeptide has insecticidal activity.

Proteins and Variants and Fragments Thereof

PIP-72 polypeptides are also encompassed by the disclosure. "*Pseudomonas* Insecticidal Protein-72", "PIP-72 polypeptide" or "PIP-72 protein" as used herein interchangeably refers to a polypeptide having pesticidal activity including but not limited to insecticidal activity against one or more insect pests of the Coleoptera order, and is sufficiently homologous to the protein of SEQ ID NO: 2. A variety of PIP-72 polypeptides are contemplated. Sources of polynucleotides that encode PIP-72 polypeptides or related proteins include but are not limited to: a *Pseudomonas chlororaphis* strain which contains the PIP-72Aa polynucleotide of SEQ ID NO: 1 encoding the PIP-72Aa polypeptide of SEQ ID NO: 2; a *Pseudomonas rhodesiae* strain which contains the PIP-72Ba polynucleotide of SEQ ID NO: 3 encoding the PIP-72Ba polypeptide of SEQ ID NO: 4; a *Pseudomonas chlororaphis* strain which contains the PIP-72Ca polynucleotide of SEQ ID NO: 5 encoding the PIP-72Ca polypeptide of SEQ ID NO: 6; a *Pseudomonas mandelii* strain which contains the PIP-72Cb polynucleotide of SEQ ID NO: 7 encoding the PIP-72Cb polypeptide of SEQ ID NO: 8; a *Pseudomonas congelans* strain which contains the PIP-72 Da polynucleotide of SEQ ID NO: 9 encoding the PIP-72 Da polypeptide of SEQ ID NO: 10; a *Pseudomonas mandelii* strain which contains the PIP-72Db polynucleotide of SEQ ID NO: 11 encoding the PIP-72Db polypeptide of SEQ ID NO: 12; a *Pseudomonas ficuserectae* strain which contains the PIP-72Dc polynucleotide of SEQ ID NO: 13 encoding the PIP-72Dc polypeptide of SEQ ID NO: 14; a *Pseudomonas mosselii* strain which contains the PIP-72Fa polynucleotide of SEQ ID NO: 17 encoding the PIP-72Fa polypeptide of SEQ ID NO: 18; a *Pseudomonas chlororaphis* strain which contains the PIP-72Ff polynucleotide of SEQ ID NO: 27 encoding the PIP-72Ff polypeptide of SEQ ID NO: 28 and a *Pseudomonas chlororaphis* strain which contains the PIP-72Gb polynucleotide of SEQ ID NO: 31 encoding the PIP-72Gb polypeptide of SEQ ID NO: 32; a *Pseudomonas chlororaphis* strain which contains the PIP-72Ab polynucleotide of SEQ ID NO: 949 encoding the PIP-72Ab polypeptide of SEQ ID NO: 927; a *Pseudomonas brassicacearum* strain which contains the PIP-72Bb polynucleotide of SEQ ID NO: 950 encoding the PIP-72Ab polypeptide of SEQ ID NO: 928; a *Pseudomonas entomophila* strain which contains the PIP-72Fh polynucleotide of SEQ ID NO: 954 encoding the PIP-72AFh polypeptide of SEQ ID NO: 932; a *Pseudomonas entomophila* strain which contains the PIP-72Fh polynucleotide of SEQ ID NO: 955 encoding the PIP-72AFh polypeptide of SEQ ID NO: 933; a *Pseudomonas chlororaphis* strain which contains the PIP-72Fj polynucleotide of SEQ ID NO: 956 encoding the PIP-72Fj polypeptide of SEQ ID NO: 934; a *Pseudomonas chlororaphis* strain which contains the PIP-72Fk polynucleotide of SEQ ID NO: 957 encoding the PIP-72Fk polypeptide of SEQ ID NO: 935; a *Burkholderia multivorans* strain which contains the PIP-72Fl polynucleotide of SEQ ID NO: 958 encoding the PIP-72Fl polypeptide of SEQ ID NO: 936; a *Pseudomonas chlororaphis* strain which contains the PIP-72Gg polynucleotide of SEQ ID NO: 961 encoding the PIP-72Gg polypeptide of SEQ ID NO: 939; a *Pseudomonas chlororaphis* strain which contains the PIP-72Gh polynucleotide of SEQ ID NO: 962 encoding the PIP-72Gh polypeptide of SEQ ID NO: 940; a *Pseudomonas mosselii* strain which contains the PIP-72Gi polynucleotide of SEQ ID NO: 963 encoding the PIP-72Gi polypeptide of SEQ ID NO: 941; a *Pseudomonas protegens* strain which contains the PIP-72Gk polynucleotide of SEQ ID NO: 965 encoding the PIP-72Gk polypeptide of SEQ ID NO: 943; a *Pseudomonas plecoglossicida* strain which contains the PIP-72Gl polynucleotide of SEQ ID NO: 966 encoding the PIP-72Gl polypeptide of SEQ ID NO: 944; and a *Pseudomonas chlororaphis* strain which contains the PIP-72Gn polynucleotide of SEQ ID NO: 968 encoding the PIP-72Gn polypeptide of SEQ ID NO: 946. In some embodiments, the insecticidal activity is against western corn rootworm, *Diabrotica virgifera virgifera*.

In some embodiments a PIP-72 polypeptide is sufficiently homologous to the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946. "Sufficiently homologous" is used herein to refer to an amino acid sequence that has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% or greater sequence homology compared to a reference sequence using one of the alignment programs described herein using standard parameters. One of skill in the art will recognize that these values can be appropriately adjusted to determine corresponding homology of proteins taking into account amino acid similarity and the like. In some embodiments the sequence homology is against the full length sequence a PIP-72 polypeptide. In some embodiments the PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% or greater sequence identity compared to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946. In some embodiments the sequence identity is against the full length sequence of a PIP-72 polypeptide. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. A PIP-72 polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to a PIP-72 polypeptide and that exhibit insecticidal activity. "Fragments" or "biologically active portions" of PIP-72 polypeptides includes fragments comprising amino acid sequences sufficiently identical to the amino acid sequence set forth in SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946, respectively. A biologically active portion of a PIP-72 polypeptide can be a polypeptide that is, for example, 10, 25, 50, 55, 60, 61, 62, 63, 64, 65, 66, 67, 68, 69, 70, 71, 72, 73, 74, 75, 76, 77, 78, 79, 80, 81, 82, 83, 84 or 85 amino acids in length. Such biologically active portions can be prepared by recombinant techniques and evaluated for insecticidal activity. As used here, a fragment comprises at least 8 contiguous amino acids of a PIP-72 polypeptide. In some embodiments a PIP-72 polypeptide fragment comprises at least 8 contiguous amino acids of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946. In some embodiments, the PIP-72 polypeptide fragment is an N-terminal and/or a C-terminal truncation of at least about 1, 2, 3, 4, 5, 6, 7, 8, 9, 10, 11, 12, 13, 14 or more amino acids from the N-terminus and/or C-terminus relative to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946, e.g., by proteolysis, by insertion of a start codon, by deletion of the codons encoding the deleted amino acids and concomitant insertion of a start codon, and/or insertion of a stop codon.

In some embodiments, the PIP-72 polypeptide fragments encompassed herein result from the removal of the N-terminal 1, 2, 3, 4, 5, 6, 7, 8, 9 or 10 or more amino acids relative to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946, e.g., by proteolysis or by insertion of a start codon, by deletion of the codons encoding the deleted amino acids and concomitant insertion of a start codon.

In some embodiments, the PIP-72 polypeptide fragments encompassed herein result from the removal of the N-terminal 1, 2, 3, 4, 5, 6, 7, 8, 9 or 10 amino acids relative to SEQ ID NO: 2, SEQ ID NO: 4, SEQ ID NO: 6, SEQ ID NO: 8 or variants thereof including, but not limited to any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946. In some embodiments the truncation is of the first 4 amino acids of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32 or variants thereof including, but not limited to any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946.

"Variants" as used herein refers to proteins or polypeptides having an amino acid sequence that is at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identical to the parental amino acid sequence. The term "about" as used herein with respect to % sequence identity means up to and including ±0.5% in 0.1% increments. For example "about 90%" sequence identity includes 89.5%, 89.6%, 89.7%, 89.8%, 89.9%, 90%, 90.1%, 90.2%, 90.3%, 90.4% and 90.5%.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 2.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 4.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 6.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 8.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 10.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 12.

In some embodiments a PIP-72 polypeptide has at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 14.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 18.

In some embodiments a PIP-72 polypeptide has at least about 85%, 86%, 87%, 88%, 89%, 90%, 91%, 92%, 93%, 94%, 95%, 96%, 97%, 98%, 99% or greater identity across the entire length of the amino acid sequence of SEQ ID NO: 28.

In some embodiments a PIP-72 polypeptide has at least about 95%, 96%, 97%, 98%, 99% or greater identity across the entire length of the amino acid sequence of SEQ ID NO: 32.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 927.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 928.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 932.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 933.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 934.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 935.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 936.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 939.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 940.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 941.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 943.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 944.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 945.

In some embodiments a PIP-72 polypeptide has at least about 60%, 61%, 62%, 63%, 64%, 65%, 66%, 67%, 68%, 69%, 70%, 71%, 72%, 73%, 74%, 75%, 76%, 77%, 78%, 78%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 946.

In some embodiments a PIP-72 polypeptide comprises an amino acid sequence having at least 50% identity to the amino acid sequence of SEQ ID NO: 2, SEQ ID NO: 4, SEQ ID NO: 6, SEQ ID NO: 8, SEQ ID NO: 10, SEQ ID NO: 12 or SEQ ID NO: 14, wherein the polypeptide has insecticidal activity.

In some embodiments a PIP-72 polypeptide comprises an amino acid sequence having at least 70% identity to the amino acid sequence of SEQ ID NO: 2, SEQ ID NO: 4, SEQ ID NO: 6, SEQ ID NO: 8, SEQ ID NO: 10, SEQ ID NO: 12 or SEQ ID NO: 14, wherein the polypeptide has insecticidal activity.

In some embodiments a PIP-72 polypeptide comprises an amino acid sequence having at least 50% identity to the amino acid sequence of SEQ ID NO: 2, wherein the polypeptide has insecticidal activity.

In some embodiments a PIP-72 polypeptide comprises an amino acid sequence having at least 50% identity to the amino acid sequence of SEQ ID NO: 4, wherein the polypeptide has insecticidal activity.

In some embodiments a PIP-72 polypeptide comprises an amino acid sequence having at least 50% identity to the amino acid sequence of SEQ ID NO: 6, wherein the polypeptide has insecticidal activity.

In some embodiments a PIP-72 polypeptide comprises an amino acid sequence having at least 50% identity to the amino acid sequence of SEQ ID NO: 8, wherein the polypeptide has insecticidal activity.

In some embodiments a PIP-72 polypeptide comprises an amino acid sequence having at least 50% identity to the amino acid sequence of SEQ ID NO: 10, wherein the polypeptide has insecticidal activity.

In some embodiments a PIP-72 polypeptide comprises an amino acid sequence having at least 50% identity to the amino acid sequence of SEQ ID NO: 12, wherein the polypeptide has insecticidal activity.

In some embodiments a PIP-72 polypeptide comprises an amino acid sequence having at least 50% identity to the amino acid sequence of SEQ ID NO: 14, wherein the polypeptide has insecticidal activity.

In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments the PIP-72 polypeptide comprises an amino acid motif as represented by amino acid residues 37-51 of SEQ ID NO: 846, SEQ ID NO: 847, SEQ ID NO: 848 or SEQ ID NO: 849.

In some embodiments, the PIP-72 polypeptide comprises an amino acid sequence of SEQ ID NO: 2 having an amino acid substitution at one or more residues selected from residues 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 57, 58, 59, 60, 62, 63, 64, 65, 66, 67, 68, 69, 70, 71, 72, 73, 74, 75, 76, 77, 78, 79, 80, 81, 82, 83, 84, 85 or 86, of SEQ ID NO: 2 in any combination, and optionally the PIP-72 polypeptide further comprises a deletion of 1 to 5 amino acids, an insertion of 1 to 5 amino acids, addition of one or more amino acids at the N-terminus and/or addition of one or more amino acids at the C-terminus relative to SEQ ID NO: 2, in any combination.

In some embodiments, the PIP-72 polypeptide comprises an amino acid sequence of SEQ ID NO: 2 having an amino acid substitution at one or more residues selected from residues 2, 3, 4, 5, 6, 7, 8, 9, 10, 11, 12, 13, 14, 15, 17, 18, 19, 20, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 58, 60, 63, 64, 65, 66, 67, 68, 69, 70, 71, 72, 73, 74, 75, 76, 77, 78, 79, 80, 81, 82, 83, 84, 85 or 86 of SEQ ID NO: 2, in any combination, and optionally the PIP-72 polypeptide further comprises a deletion of 1 to 5 amino acids, an insertion of 1 to 5 amino acids, addition of one or more amino acids at the N-terminus or addition of one or more amino acids at the C-terminus relative to SEQ ID NO: 2, in any combination.

In some embodiments, the PIP-72 polypeptide comprises an amino acid sequence of SEQ ID NO: 2 having an amino acid substitution at 1 to 45 residues selected from residues 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 57, 58, 59, 60, 62, 63, 64, 65, 66, 67, 68, 69, 70, 71, 72, 73, 74, 75, 76, 77, 78, 79, 80, 81, 82, 83, 84, 85 and 86, of SEQ ID NO: 2 in any combination, and optionally the PIP-72 polypeptide further comprises a deletion of 1 to 5 amino acids, an insertion of 1 to 5 amino acids, addition of one or more amino acids at the N-terminus and/or addition of one or more amino acids at the C-terminus relative to SEQ ID NO: 2, in any combination.

In some embodiments, the PIP-72 polypeptide comprises an amino acid sequence of SEQ ID NO: 2 having an amino acid substitution compared to the native amino acid of SEQ ID NO: 2 at 1 to 45 residues selected from residues 2, 3, 4, 5, 6, 7, 8, 9, 10, 11, 12, 13, 14, 15, 17, 18, 19, 20, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 58, 60, 63, 64, 65, 66, 67, 68, 69, 70, 71, 72, 73, 74, 75, 76, 77, 78, 79, 80, 81, 82, 83, 84, 85 and 86 of SEQ ID NO: 2, in any combination, and optionally the PIP-72 polypeptide further comprises a deletion of 1 to 5 amino acids, an insertion of 1 to 5 amino acids, addition of one or more amino acids at the N-terminus and/or addition of one or more amino acids at the C-terminus relative to SEQ ID NO: 2, in any combination.

In specific embodiments, the substitution is an alanine for the native amino acid at the recited position(s). Also encompassed are the nucleic acid sequence(s) encoding the variant protein or polypeptide.

In some embodiments the PIP-72 polypeptide comprising an amino acid sequence of SEQ ID NO: 846, wherein Xaa at position 2 is Gly, Ala, Cys, Asp, Glu, Ile, Lys, Leu, Asn, Arg, Ser, Thr, Val, Trp or Tyr; Xaa at position 3 is Ile or Trp; Xaa at position 4 is Thr, Ala, Asp, Glu, His, Ile, Lys, Leu, Arg, Ser, Val, Trp or Tyr; Xaa at position 5 is Val, Ala, Cys, Gly, His, Ile or Tyr; Xaa at position 6 is Thr, Ala, Cys, Phe, Gly, His, Ile, Lys, Met, Pro, Gln, Arg, Ser, Trp or Tyr; Xaa at position 7 is Asn, Ala or Val; Xaa at position 8 is Asn, Ala, Cys, Asp, Glu, Gly, His, Ile, Lys, Leu, Met, Gln, Arg, Ser, Thr or Val; Xaa at position 9 is Ser, Ala, Cys, Gly or Thr; Xaa at position 10 is Ser, Ala, Glu, Phe, Gly, His, Ile, Lys, Leu, Asn, Pro, Gln, Arg, Thr or Trp; Xaa at position 11 is Asn, Ala, Cys, Asp, Glu, Gly, His, Ile, Lys, Leu, Met, Gln, Ser, Thr, Val or Tyr; Xaa at position 12 is Pro, Ala, Cys, Asp, Glu, Gly, His, Lys, Leu, Asn, Gln, Arg, Ser, Thr, Val, Trp or Tyr; Xaa at position 13 is Ile, Asn, Gln or Val; Xaa at position 14 is Glu, Ala, Cys, Phe, His, Lys or Gln; Xaa at position 15 is Val, Ala, Cys, Ile, Met or Arg; Xaa at position 17 is Ile, Glu or Val; Xaa at position 18 is Asn or Ser; Xaa at position 19 is His, Ala, Glu, Lys, Leu, Pro, Arg, Ser or Tyr; Xaa at position 20 is Trp, Ala or Thr; Xaa at position 22 is Ser, Ala, Asp, Phe, Gly, His, Ile, Lys, Leu, Met, Asn, Pro, Gln, Arg, Thr, Val or Tyr; Xaa at position 23 is Asp, Ala, Gly, His, Lys, Met, Asn, Gln, Ser, Thr or Val; Xaa at position 24 is Gly, Asp or Phe; Xaa at position 25 is Asp, Ala, Glu, Phe, Asn or Gln; Xaa at position 26 is Thr, Glu or Pro; Xaa at position 27 is Ser, Ala, Cys, Asp, Glu, Phe, Gly, His, Asn, Gln, Arg or Thr; Xaa at position 28 is Phe, Pro, Trp or Tyr; Xaa at position 29 is Phe, Ala, Cys, Ile, Leu, Gln, Arg, Trp or Tyr; Xaa at position 30 is Ser, Ala, Cys, Asp, Glu, Phe, Gly, His, Lys, Leu, Met, Asn, Pro, Gln, Arg, Thr, Val, Trp or Tyr; Xaa at position 31 is Val, Ile or Leu; Xaa at position 32 is Gly, Ala, Asp, Glu, Phe, His, Lys, Leu, Met, Asn, Pro, Gln, Arg, Ser, Thr, Val, Trp or Tyr; Xaa at position 33 is Asn, Ala, Cys, Asp, Glu, Phe, Gly, His, Ile, Lys, Leu, Pro, Gln, Arg, Ser, Thr, Val or Tyr; Xaa at position 34 is Gly, Glu, Phe, His, Lys, Leu, Met, Asn, Gln, Arg, Ser, Thr or Tyr; Xaa at position 35 is Lys, Ala, Cys, Asp, Gly, His, Ile, Leu, Met, Asn, Gln, Arg, Ser, Thr or Val; Xaa at position 36 is Gln, Ala, Cys, Glu, Gly, His, Ile, Lys, Leu, Asn, Pro, Arg, Ser, Thr or Val; Xaa at position 37 is Glu, Ala, Cys, Asp, Phe, Gly, Ile, Lys, Leu, Met, Asn, Ser, Thr or Val; Xaa at position 38 is Thr, Ala, Cys, Asp, Glu, Phe, Gly, His, Ile, Leu, Met, Asn, Gln, Arg, Ser, Val, Trp or Tyr; Xaa at position 39 is Trp or Phe; Xaa at position 40 is Asp, Ala, Cys, Glu, Phe, Gly, His, Ile, Lys, Leu, Met, Asn, Gln, Arg, Ser, Thr, Val, Trp or Tyr; Xaa at position 42 is Ser, Ala, Cys, Asp, Glu, Phe, Gly, Ile, Lys, Leu, Met, Asn, Gln, Arg, Thr, Val, Trp or Tyr; Xaa at position 44 is Ser, Ala, Asp, Glu, Gly, Leu, Met, Asn, Pro, Gln, Thr, Val or Tyr; Xaa at position 45 is Arg, Lys or Ser; Xaa at position 46 is Gly, Ala or Gln; Xaa at position 47 is Phe, Cys, Val or Tyr; Xaa at position 48 is Val, Ile or Leu; Xaa at position 49 is Leu, Cys, Phe, Met, Arg or Tyr; Xaa at position 50 is Ser, Ala, Cys, Asp, Ile, Met, Pro, Gln, Thr or Val; Xaa at position 51 is Leu, Ala, Cys, Met or Val; Xaa at position 52 is Lys, Cys, Phe, His, Ile, Leu, Met, Asn, Arg, Ser, Thr, Trp or Tyr; Xaa at position 53 is Lys, Ala, Cys, Asp, Glu, Phe, His, Ile, Leu, Met, Asn, Gln, Arg, Ser, Thr, Val or Tyr; Xaa at position 54 is Asn, Cys, Asp, Glu, Phe, Gly, Lys, Met, Gln, Arg, Ser or Trp; Xaa at position 56 is Ala, Gly, Leu, Asn, Pro, Gln, Arg, Ser or Thr; Xaa at position 57 is Gln, Glu, Leu, Met, Ser or Thr; Xaa at position 58 is His, Ala, Asp, Phe, Leu, Met, Asn, Arg, Trp or Tyr; Xaa at position 60 is Tyr, Glu or Phe; Xaa at position 63 is Gln, Cys, Gly, Ile, Leu, Met, Asn, Thr, Val or Tyr; Xaa at position 64 is Ala, Phe, Gly, His, Arg, Ser or Tyr; Xaa at position 65 is Ser, Ala, Cys, Asp, Glu, Phe, Gly, His, Ile, Leu, Asn, Thr or Val; Xaa at position 66 is Ser, Ala or Gly; Xaa at position 67 is Lys, Ala, Cys, Asp, Phe, His, Ile, Leu, Met, Asn, Gln, Arg, Ser, Thr, Val, Trp or Tyr; Xaa at position 68 is Ile Asp, Leu or Val; Xaa at position 69 is Glu, Ala, Cys, Asp, Phe, His, Ile, Leu, Met, Gln, Arg, Ser, Thr, Val or Tyr; Xaa at position 70 is Val, Cys or Ile; Xaa at position 71 is Asp, Ala, Cys, Gly, His, Ile, Leu, Met, Asn, Ser, Thr, Val or Tyr; Xaa at position 72 is Asn, Ala, Cys, Asp, Glu, Gly, Lys, Met, Pro, Gln, Arg, Ser, Thr, Val or Trp; Xaa at position 73 is Asn, Ala, Cys, Asp, Phe, Gly, His, Ile, Leu, Ser, Thr, Val or Tyr; Xaa at position 74 is Ala, Cys, Asp, Phe, Gly, His, Ile, Leu, Asn, Gln, Arg, Ser, Thr, Val or Tyr; Xaa at position 75 is Val, Cys, Ile or Leu; Xaa at position 76 is Lys, Ala, Cys, Phe, His, Ile, Leu, Gln, Arg, Ser, Thr, Val, Trp or Tyr; Xaa at position 77 is Asp Tyr; Xaa at position 78 is Gln, Ala, Cys, Asp, Phe, Gly, His, Ile, Leu, Met, Asn, Arg, Ser, Thr, Val or Tyr; Xaa at position 79 is Gly, Arg, Ala, Cys, Asp, Glu, Phe, His, Lys, Leu, Asn, Gln, Arg, Ser, Thr, Trp or Tyr; Xaa at position 80 is Arg, Ala, Cys, Asp, Phe, Gly, His, Ile, Leu, Asn, Ser, Thr, Val or Tyr; Xaa at position 81 is Leu, Ala, Cys, Asp, Phe, Gly, His, Ile, Asn, Pro, Arg, Ser, Thr or Val; Xaa at position 82 is Ile, Ala, Leu, Met, Arg or Val; Xaa at position 83 is Glu, Ala, Cys, Asp, Phe, Gly, His, Ile, Lys, Leu, Asn, Pro, Arg, Ser, Thr, Val or Tyr; Xaa at position 84 is Pro, Ala, Cys, Glu, Ile, Ser, Val, Trp or Tyr; Xaa at position 85 is Leu, Cys, Gly or Val; and Xaa at position 86 is Ser, Ala, Ile, Thr or Val, and wherein 1 to 14 amino acids are optionally deleted from the N-terminus and/or C-terminus of the PIP-72 polypeptide.

In some embodiments a PIP-72 polypeptide comprises an amino acid sequence of SEQ ID NO: 846 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45, amino acid substitutions, in any combination, at residues designated by Xaa in SEQ ID NO: 846 compared to the native amino acid at the corresponding position of SEQ ID NO: 2.

In some embodiments a PIP-72 polypeptide comprises an amino acid sequence of SEQ ID NO: 846 having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, at residues designated by Xaa in SEQ ID NO: 846 compared to the native amino acid at the corresponding position of SEQ ID NO: 2.

In some embodiments a PIP-72 polypeptide comprises an amino acid sequence of SEQ ID NO: 847, wherein Xaa at position 2 is Gly, Lys or Ala; Xaa at position 3 is Ile or Leu; Xaa at position 4 is Thr or Ser; Xaa at position 5 is Val or Ile; Xaa at position 6 is Thr or Lys; Xaa at position 8 is Asn, Lys, Gly or Ser; Xaa at position 9 is Ser or Ala; Xaa at position 11 is Asn, Lys, His or Thr; Xaa at position 12 is Pro, Thr, Lys or Ser; Xaa at position 13 is Ile or Val; Xaa at position 14 is Glu or Asp; Xaa at position 15 is Val, Ala or Ile; Xaa at position 16 is Ala or Ser; Xaa at position 17 is Ile or Val; Xaa at position 18 is Asn or Ser; Xaa at position 19 is His, Lys, Arg, Gln or Ala; Xaa at position 21 is Gly or Arg; Xaa at position 22 is Ser, Lys, Asn, Asp or Thr; Xaa at position 25 is Asp or Asn; Xaa at position 26 is Thr or Asp; Xaa at position 27 is Ser, Thr, Asn or Lys; Xaa at position 28 is Phe, Tyr or Pro; Xaa at position 29 is Phe or Tyr; Xaa at position 30 is Ser, Gly or Lys; Xaa at position 31 is Val, Ile or Met; Xaa at position 32 is Gly, Ala or Asp; Xaa at position 33 is Asn, Ser, Gln or Pro; Xaa at position 35 is Lys, Glu or Ser; Xaa at position 36 is Gln, Asn or Ser; Xaa at position 37 is Glu or Asp; Xaa at position 38 is Thr or Ser; Xaa at position 42 is Ser or Asn; Xaa at position 44 is Ser, Asp, Ala or Leu; Xaa at position 47 is Phe or Tyr; Xaa at position 48 is Leu or Met; Xaa at position 49 is Leu or Met; Xaa at position 50 is Ser, Ala or Tyr; Xaa at position 51 is Leu or Val; Xaa at position 52 is Lys or Gln; Xaa at position 53 is Lys, Arg, Met or Leu; Xaa at position 54 is Asn, Lys or Gly; Xaa at position 55 is Gly or Ser; Xaa at position 56 is Ala, Thr, Gln or Ser; Xaa at position 57 is Gln, Val or Ala; Xaa at position 58 is His, Ala, Lys, Tyr or Thr; Xaa at position 59 is Pro or Thr; Xaa at position 62 is Val or Ile; Xaa at position 63 is Gln, Ser or Leu; Xaa at position 64 is Ala, Gln or Ser; Xaa at position 65 is Ser or Thr; Xaa at position 67 is Lys, Gln, Arg or Asn; Xaa at position 69 is Glu, Lys or Val; Xaa at position 70 is Val or Ile; Xaa at position 71 is Asp, Glu or Tyr; Xaa at position 72 is Asn, His, Ser or Asp; Xaa at position 73 is Asn, Ser or Asp; Xaa at position 74 is Ala, Thr, Met, Ile or Lys; Xaa at position 76 is Lys or Thr; Xaa at position 78 is Gln, His or Ser; Xaa at position 80 is Arg, Glu or Gln; Xaa at position 81 is Leu, Pro, Ala or Thr; Xaa at position 82 is Ile or Leu; Xaa at position 83 is Glu, His, Asn, Gln or Leu; Xaa at position 85 is Leu, Val or Ala; and Xaa at position 86 is Ser, Ala, Tyr or Asn, and wherein 1 to 14 amino acids are optionally deleted from the N-terminus and/or C-terminus of the PIP-72 polypeptide and/or an amino acid is inserted between residue 24 and 25 relative to SEQ ID NO: 847.

In some embodiments a PIP-72 polypeptide comprises an amino acid sequence of SEQ ID NO: 847 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, in any combination, at residues designated by Xaa in SEQ ID NO: 847 compared to the native amino acid at the corresponding position of SEQ ID NO: 2.

In some embodiments a PIP-72 polypeptide comprises an amino acid sequence of SEQ ID NO: 847 having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, at residues designated by Xaa in SEQ ID NO: 847 compared to the native amino acid at the corresponding position of SEQ ID NO: 2.

In some embodiments a PIP-72 polypeptide comprises an amino acid sequence of SEQ ID NO: 848, wherein Xaa at position 2 is Gly, Lys, Ala or Arg; Xaa at position 3 is Ile, Leu or Val; Xaa at position 4 is Thr or Ser; Xaa at position 5 is Val, Ile or Leu; Xaa at position 6 is Thr, Lys, Ser or Arg; Xaa at position 8 is Asn, Lys, Gly, Ser, Gln, Arg, Thr or Ala; Xaa at position 9 is Ser, Ala or Thr; Xaa at position 11 is Asn, Lys, Thr, Gln, Arg, His or Ser; Xaa at position 12 is Pro, Thr, Lys, Ser or Arg; Xaa at position 13 is Ile, Val or Leu; Xaa at position 14 is Glu or Asp; Xaa at position 15 is Val, Ala, Ile or Leu; Xaa at position 16 is Ala or Ser; Xaa at position 17 is Ile, Val or Leu; Xaa at position 18 is Asn, Ser, Gln or Thr; Xaa at position 19 is His, Lys, Ala, Gln, Asn or Arg; Xaa at position 21 is Gly, Arg or Lys; Xaa at position 22 is Ser, Lys, Asn, Thr, Arg, Asp, Glu or Gln; Xaa at position 25 is Asp, Asn, Glu or Gln; Xaa at position 26 is Thr, Asp, Ser or Glu; Xaa at position 27 is Ser, Thr, Lys, Asn, Gln or Arg; Xaa at position 28 is Phe, Tyr, Pro or Trp; Xaa at position 29 is Phe, Tyr or Trp; Xaa at position 30 is Ser, Gly, Lys, Thr or Arg; Xaa at position 31 is Val, Ile, Met or Leu; Xaa at position 32 is Gly, Ala, Asp or Glu; Xaa at position 33 is Asn, Ser, Gln, Pro or Thr; Xaa at position 35 is Lys, Glu, Ser, Arg or Thr; Xaa at position 36 is Gln, Ser, Asn or Thr; Xaa at position 37 is Glu or Asp; Xaa at position 38 is Thr or Ser; Xaa at position 42 is Ser, Asn, Thr or Gln; Xaa at position 44 is Ser, Asp, Ala, Leu, Thr, Glu, Ile or Val; Xaa at position 47 is Phe, Tyr or Trp; Xaa at position 48 is Leu, Met, Ile or Val; Xaa at position 49 is Leu, Met, Ile or Val; Xaa at position 50 is Ser, Ala, Tyr or Thr; Xaa at position 51 is Leu, Val or Ile; Xaa at position 52 is Lys, Gln, Arg or Asn; Xaa at position 53 is Lys, Arg, Met, Leu, Ile or Val; Xaa at position 54 is Asn, Lys, Gly, Gln or Arg; Xaa at position 55 is Gly, Ser or Thr; Xaa at position 56 is Ala, Thr, Gln, Ser or Asn; Xaa at position 57 is Gln, Val, Ala, Asn, Leu or Ile; Xaa at position 58 is His, Ala, Lys, Tyr or Thr; Xaa at position 59 is Pro, Thr or Ser; Xaa at position 62 is Val, Ile or Leu; Xaa at position 63 is Gln, Ser, Leu, Asn, Thr, Ile or Val; Xaa at position 64 is Ala, Gln, Ser, Asn or Thr; Xaa at position 65 is Ser or Thr; Xaa at position 67 is Lys, Gln, Asn or Arg; Xaa at position 69 is Glu, Val, Asp, Lys, Arg, Ile or Leu; Xaa at position 70 is Val, Ile or Leu; Xaa at position 71 is Asp, Glu, Tyr or Trp; Xaa at position 72 is Asn, His, Ser, Asp, Gln, Thr or Glu; Xaa at position 73 is Asn, Ser, Asp, Gln, Thr or Glu; Xaa at position 74 is Ala, Thr, Met, Ile, Lys, Ser, Leu, Val or Arg; Xaa at position 76 is Lys, Thr, Arg or Ser; Xaa at position 78 is Gln, His, Ser, Asn or Thr; Xaa at position 80 is Arg, Glu, Gln, Lys, Asp or Asn; Xaa at position 81 is Leu, Pro, Thr, Ile, Val, Ala or Ser; Xaa at position 82 is Ile, Leu or Val; Xaa at position 83 is Glu, His, Asn, Leu, Gln, Ile or Val; Xaa at position 85 is Leu, Val or Ala; and Xaa at position 86 is Ser, Ala, Tyr, Asn or Thr, and wherein 1 to 14 amino acids are optionally deleted from the N-terminus and/or C-terminus of the PIP-72 polypeptide and/or an amino acid is inserted between residue 24 and 25 relative to SEQ ID NO: 848.

In some embodiments a PIP-72 polypeptide comprises an amino acid sequence of SEQ ID NO: 848 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, in any combination, at residues designated by Xaa in SEQ ID NO: 848 compared to the native amino acid at the corresponding position of SEQ ID NO: 2.

In some embodiments a PIP-72 polypeptide comprises an amino acid sequence of SEQ ID NO: 848 having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, at residues designated by Xaa in SEQ ID NO: 848 compared to the native amino acid at the corresponding position of SEQ ID NO: 2.

In some embodiments a PIP-72 polypeptide comprises an amino acid sequence of SEQ ID NO: 849 wherein Xaa at position 2 is Gly, Ala, Cys, Asp, Glu, Ile, Lys, Leu, Asn, Arg, Ser, Thr, Val, Trp or Tyr; Xaa at position 3 is Ile, Leu, Val or Trp; Xaa at position 4 is Thr, Ala, Asp, Glu, His, Ile, Lys, Leu, Arg, Ser, Val, Trp or Tyr; Xaa at position 5 is Val, Ala, Cys, Gly, His, Ile, Leu or Tyr; Xaa at position 6 is Thr, Ala, Cys, Phe, Gly, His, Ile, Lys, Met, Pro, Gln, Arg, Ser, Trp or Tyr; Xaa at position 7 is Asn, Ala or Val; Xaa at position 8 is Asn, Lys, Gly, Ser, Gln, Arg, Thr, Ala, Cys, Asp, Glu, His, Ile, Leu, Met or Val; Xaa at position 9 is Ser, Ala, Cys, Gly or Thr; Xaa at position 11 is Asn, Lys, Thr, Gln, Arg, Ser, Ala, Cys, Asp, Glu, Gly, His, Ile, Leu, Met, Val or Tyr; Xaa at position 12 is Pro, Thr, Lys, Ser, Arg, Ala, Cys, Asp, Glu, Gly, His, Leu, Asn, Gln, Arg, Val, Trp or Tyr; Xaa at position 13 is Ile, Asn, Gln, Leu or Val; Xaa at position 14 is Glu, Ala, Cys, Phe, His, Lys, Asp or Gln; Xaa at position 15 is Val, Ala, Ile, Leu, Cys, Met or Arg; Xaa at position 16 is Ala or Ser; Xaa at position 17 is Ile, Glu, Leu or Val; Xaa at position 18 is Asn, Gln, Thr or Ser; Xaa at position 19 is His, Lys, Ala, Arg, Glu, Leu, Pro, Ser or Tyr; Xaa at position 20 is Trp, Ala or Thr; Xaa at position 21 is Gly, Arg or Lys; Xaa at position 22 is Ser, Ala, Asp, Phe, Gly, His, Ile, Lys, Leu, Met, Asn, Pro, Gln, Arg, Thr, Val or Tyr; Xaa at position 23 is Asp, Ala, Gly, His, Lys, Met, Asn, Gln, Ser, Thr or Val; Xaa at position 24 is Gly, Asp or Phe; Xaa at position 25 is Asp, Ala, Glu, Phe, Asn or Gln; Xaa at position 26 is Thr, Glu, Asp, Ser or Pro; Xaa at position 27 is Ser, Thr, Lys, Arg, Ala, Cys, Asp, Glu, Phe, Gly, His, Asn or Gln; Xaa at position 28 is Phe, Tyr, Pro or Trp; Xaa at position 29 is Phe, Ala, Cys, Ile, Leu, Gln, Arg, Trp or Tyr; Xaa at position 30 is Ser, Gly, Lys, Thr, Arg, Ala, Cys, Asp, Glu, Phe, His, Leu, Met, Asn, Pro, Gln, Val, Trp or Tyr; Xaa at position 31 is Val, Ile, Met or Leu; Xaa at position 32 is Gly, Ala, Asp, Glu, Phe, His, Lys, Leu, Met, Asn, Pro, Gln, Arg, Ser, Thr, Val, Trp or Tyr; Xaa at position 33 is Asn, Ser, Gln, Pro, Thr, Ala, Cys, Asp, Glu, Phe, Gly, His, Ile, Lys, Leu, Arg, Val or Tyr; Xaa at position 34 is Gly, Glu, Phe, His, Lys, Leu, Met, Asn, Gln, Arg, Ser, Thr or Tyr; Xaa at position 35 is Lys, Glu, Ala, Cys, Asp, Gly, His, Ile, Leu, Met, Asn, Gln, Arg, Ser, Thr or Val; Xaa at position 36 is Gln, Ala, Cys, Glu, Gly, His, Ile, Lys, Leu, Asn, Pro, Arg, Ser, Thr or Val; Xaa at position 37 is Glu, Asp, Ala, Cys, Phe, Gly, Ile, Lys, Leu, Met, Asn, Ser, Thr or Val; Xaa at position 38 is Thr, Ser, Ala, Cys, Asp, Glu, Phe, Gly, His, Ile, Leu, Met, Asn, Gln, Arg, Val, Trp or Tyr; Xaa at position 39 is Trp or Phe; Xaa at position 40 is Asp, Ala, Cys, Glu, Phe, Gly, His, Ile, Lys, Leu, Met, Asn, Gln, Arg, Ser, Thr, Val, Trp or Tyr; Xaa at position 42 is Ser, Asn, Thr, Ala, Cys, Asp, Glu, Phe, Gly, Ile, Lys, Leu, Met, Arg, Val, Trp, Tyr or Gln; Xaa at position 44 is Ser, Asp, Ala, Leu, Thr, Glu, Ile, Ala, Gly, Leu, Met, Asn, Pro, Gln, Val, Tyr or Val; Xaa at position 45 is Arg, Lys or Ser; Xaa at position 46 is Gly, Ala or Gln; Xaa at position 47 is Phe, Tyr Cys, Val or Trp; Xaa at position 48 is Leu, Met, Ile, Cys, Phe, Met, Arg, Tyr or Val; Xaa at position 49 is Leu, Met, Ile or Val; Xaa at position 50 is Ser, Ala, Tyr, Cys, Asp, Ile, Met, Pro, Gln, Val or Thr; Xaa at position 51 is Leu, Val, Ala, Cys, Met or Ile; Xaa at position 52 is Lys, Cys, Phe, His, Ile, Leu, Met, Asn, Arg, Ser, Thr, Gln, Trp or Tyr; Xaa at position 53 is Lys, Arg, Met, Leu, Ile, Ala, Cys, Asp, Glu, Phe, His, Asn, Gln, Ser, Thr, Tyr or Val; Xaa at position 54 is Asn, Cys, Asp, Glu, Phe, Gly, Lys, Met, Gln, Arg, Ser or Trp; Xaa at position 55 is Gly, Ser or Thr; Xaa at position 56 is Ala, Thr, Gln, Ser, Gly, Leu, Pro, Arg or Asn; Xaa at position 57 is Gln, Glu, Leu, Met, Ser, Val, Ala, Asn, Ile or Thr; Xaa at position 58 is His, Ala, Lys, Asp, Phe, Leu, Met, Asn, Arg, Trp, Tyr or Thr; Xaa at position 59 is Pro, Thr or Ser; Xaa at position 60 is Tyr, Glu or Phe; Xaa at position 62 is Val, Ile or Leu; Xaa at position 63 is Gln, Ser, Cys, Gly, Ile, Leu, Met, Asn, Thr, Val or Tyr; Xaa at position 64 is Ala, Gln, Asn, Phe, Gly, His, Arg, Ser or Tyr; Xaa at position 65 is Ser, Ala, Cys, Asp, Glu, Phe, Gly, His, Ile, Leu, Asn, Val or Thr; Xaa at position 66 is Ser, Ala or Gly; Xaa at position 67 is Lys, Gln, Asn or Arg; Xaa at position 67 is Lys, Ala, Cys, Asp, Phe, His, Ile, Leu, Met, Asn, Gln, Arg, Ser, Thr, Val, Trp or Tyr; Xaa at position 68 is Ile Asp, Leu or Val; Xaa at position 69 is Glu, Ala, Cys, Asp, Phe, His, Ile, Leu, Met, Gln, Arg, Ser, Thr, Val or Tyr; Xaa at position 70 is Val, Ile, Cys or Leu; Xaa at position 71 is Asp, Glu, Tyr, Ala, Cys, Gly, His, Ile, Leu, Met, Asn, Ser, Thr, Val or Trp; Xaa at position 72 is Asn, Ala, Cys, Asp, Glu, Gly, Lys, Met, Pro, Gln, Arg, Ser, Thr, Val, His or Trp; Xaa at position 73 is Asn, Ser, Asp, Gln, Thr, Ala, Cys, Phe, Gly, His, Ile, Leu, Val, Tyr or Glu; Xaa at position 74 is Ala, Thr, Met, Ile, Lys, Ser, Leu, Val, Cys, Asp, Phe, Gly, His, Asn, Gln, Tyr or Arg; Xaa at position 75 is Val, Cys, Ile or Leu; Xaa at position 76 is Lys, Ala, Cys, Phe, His, Ile, Leu, Gln, Arg, Ser, Thr, Val, Trp or Tyr; Xaa at position 77 is Asp Tyr; Xaa at position 78 is Gln, His, Ser, Asn, Ala, Cys, Asp, Phe, Gly, Ile, Leu, Met, Asn, Arg, Val, Tyr or Thr; Xaa at position 79 is Gly, Arg, Ala, Cys, Asp, Glu, Phe, His, Lys, Leu, Asn, Gln, Arg, Ser, Thr, Trp or Tyr; Xaa at position 80 is Arg, Glu, Gln, Lys, Asp, Ala, Cys, Phe, Gly, His, Ile, Leu, Ser, Thr, Val, Tyr or Asn; Xaa at position 81 is Leu, Pro, Thr, Ile, Val, Ala, Cys, Asp, Phe, Gly, His or Ser; Xaa at position 82 is Ile, Ala, Leu, Met, Arg and Val; Xaa at position 83 is Glu, His, Asn, Leu, Gln, Ile, Ala, Cys, Asp, Phe, Gly, Lys, Pro, Arg, Ser, Thr, Tyr or Val; Xaa at position 84 is Pro, Ala, Cys, Glu, Ile, Ser, Val, Trp or Tyr; Xaa at position 85 is Leu, Val, Cys, Gly or Ala; and Xaa at position 86 is Ser, Ala, Tyr, Asn, Ile, Val or Thr, and wherein, 1 to 14 amino acids are optionally deleted from the N-terminus and/or C-terminus of the PIP-72 polypeptide and/or an amino acid is inserted between residue 24 and 25 relative to SEQ ID NO: 849.

In some embodiments a PIP-72 polypeptide comprises an amino acid sequence of SEQ ID NO: 849 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, in any combination, at residues designated by Xaa in SEQ ID NO: 849 compared to the native amino acid at the corresponding position of SEQ ID NO: 2.

In some embodiments a PIP-72 polypeptide comprises an amino acid sequence of SEQ ID NO: 849 having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, at residues designated by Xaa in SEQ ID NO: 849 compared to the native amino acid at the corresponding position of SEQ ID NO: 2.

In some embodiments exemplary PIP-72 polypeptides are encoded by the polynucleotide sequence set forth in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 27, SEQ ID NO: 31, any one of SEQ ID NO: 287-SEQ ID NO: 527, any one of SEQ ID NO: 796-SEQ ID NO: 815, SEQ ID NO: 769, SEQ ID NO: 770, SEQ ID NO: 850, SEQ ID NO: 852, any one of SEQ ID NO: 853-SEQ ID NO: 864, any one of SEQ ID NO: 915-SEQ ID NO: 926, SEQ ID NO: 949, SEQ ID NO: 950, SEQ ID NO: 954, SEQ ID NO: 955, SEQ ID NO: 956, SEQ ID NO: 957, SEQ ID NO: 958, SEQ ID NO: 961, SEQ ID NO: 962, SEQ ID NO: 963, SEQ ID NO: 965, SEQ ID NO: 966, SEQ ID NO: 967 or SEQ ID NO: 968.

In some embodiments the PIP-72 polypeptide is encoded by the polynucleotide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 17, SEQ ID NO: 27, SEQ ID NO: 31, SEQ ID NO: 769, SEQ ID NO: 770, SEQ ID NO: 850, SEQ ID NO: 852, SEQ ID NO: 949, SEQ ID NO: 950, SEQ ID NO: 954, SEQ ID NO: 955, SEQ ID NO: 956, SEQ ID NO: 957, SEQ ID NO: 958, SEQ ID NO: 961, SEQ ID NO: 962, SEQ ID NO: 963, SEQ ID NO: 965, SEQ ID NO: 966, SEQ ID NO: 967 or SEQ ID NO: 968.

In some embodiments exemplary PIP-72 polypeptides are set forth in SEQ ID NO: 2, SEQ ID NO: 4, SEQ ID NO: 6, SEQ ID NO: 8, SEQ ID NO: 10, SEQ ID NO: 12, SEQ ID NO: 14; SEQ ID NO: 18, SEQ ID NO: 28, SEQ ID NO: 32, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 546, SEQ ID NO: 547, SEQ ID NO: 548, SEQ ID NO: 549, SEQ ID NO: 550, SEQ ID NO: 551, SEQ ID NO: 552, SEQ ID NO: 553, SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 580, SEQ ID NO: 581, SEQ ID NO: 582, SEQ ID NO: 583, SEQ ID NO: 584, SEQ ID NO: 585, SEQ ID NO: 586, SEQ ID NO: 587, SEQ ID NO: 588, SEQ ID NO: 589, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 634, SEQ ID NO: 635, SEQ ID NO: 636, SEQ ID NO: 637, SEQ ID NO: 638, SEQ ID NO: 639, SEQ ID NO: 640, SEQ ID NO: 641, SEQ ID NO: 642, SEQ ID NO: 643, SEQ ID NO: 644, SEQ ID NO: 645, SEQ ID NO: 646, SEQ ID NO: 647, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, SEQ ID NO: 664, SEQ ID NO: 665, SEQ ID NO: 666, SEQ ID NO: 667, SEQ ID NO: 668, SEQ ID NO: 669, SEQ ID NO: 670, SEQ ID NO: 671, SEQ ID NO: 672, SEQ ID NO: 673, SEQ ID NO: 674, SEQ ID NO: 675, SEQ ID NO: 676, SEQ ID NO: 677, SEQ ID NO: 678, SEQ ID NO: 679, SEQ ID NO: 680, SEQ ID NO: 681, SEQ ID NO: 682, SEQ ID NO: 683, SEQ ID NO: 684, SEQ ID NO: 685, SEQ ID NO: 686, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO: 700, SEQ ID NO: 701, SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, SEQ ID NO: 723, SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 771, SEQ ID NO: 772, SEQ ID NO: 825, SEQ ID NO: 826, SEQ ID NO: 827, SEQ ID NO: 828, SEQ ID NO: 829, SEQ ID NO: 830, SEQ ID NO: 831, SEQ ID NO: 832, SEQ ID NO: 833, SEQ ID NO: 834, SEQ ID NO: 835, SEQ ID NO: 836, SEQ ID NO: 837, SEQ ID NO: 838, SEQ ID NO: 839, SEQ ID NO: 840, SEQ ID NO: 841, SEQ ID NO: 842, SEQ ID NO: 843, SEQ ID NO: 844, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 864, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 and SEQ ID NO: 946.

In some embodiments the PIP-72 polypeptide comprises an amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14; SEQ ID NO: 18, SEQ ID NO: 28, SEQ ID NO: 32, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945 or SEQ ID NO: 946.

In some embodiments exemplary PIP-72 polypeptides are the polypeptides shown in Table 14, Table 17, Table 20, Table 23, Table 24, Table 26, Table 28, and/or Table 29 and any combinations of the amino acid substitutions thereof as well as deletions and or insertions and fragments thereof.

In some embodiments a PIP-72 polypeptide has a calculated molecular weight of between about 6 kDa and about 13 kDa between about 7 kDa and about 12 kDa, between about 8 kDa and about 11 kDa, between about 9 kDa and about 10 kDa, about 8.75 kDa, about 9 kDa, about 9.25 kDa, about 9.5 kDa, about 9.75 kDa, about 10 kDa, about 10.25 kDa, and about 10.5 kDa. As used herein, the term "about" used in the context of molecular weight of a PIP-72 polypeptide means±0.25 kilodaltons.

In some embodiments the PIP-72 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the PIP-72 polypeptide has increased digestibility of proteolytic fragments in an insect gut. Models for digestion by simulated simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al *J. Agric Food Chem.* 50: 7154-7160, 2002).

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In another aspect the PIP-72 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.*, 271:22159-22168).

This intervening sequence or protein splicing element, referred to as inteins, which catalyze their own excision through three coordinated reactions at the N-terminal and C-terminal splice junctions: an acyl rearrangement of the N-terminal cysteine or serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.,* 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207: 187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.,* 120:5591-5592). For the application of inteins in plant transgenes, see Yang, et al., (*Transgene Res* 15:583-593 (2006)) and Evans, et al., (*Annu. Rev. Plant Biol.* 56:375-392 (2005)).

In another aspect the PIP-72 polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the PIP-72 polypeptide and the 3' intein coding sequence is linked to the 5' end of the second fragment coding for the C-terminal part of the PIP-72 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.il/~pietro/inteins/Inteinstable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387: 422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a particular pair of polypeptides is able to associate with each other to provide a functional intein, using routine methods and without the exercise of inventive skill.

In another aspect the PIP-72 polypeptide is a circular permuted variant. In certain embodiments the PIP-72 polypeptide is a circular permuted variant of the polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO:

914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945, or SEQ ID NO: 946.

The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Funct. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted PIP-72 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted PIP-72 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another aspect fusion proteins are provided that include within its amino acid sequence an amino acid sequence comprising a PIP-72 polypeptide including but not limited to the polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 846, SEQ ID NO: 847, SEQ ID NO: 848, SEQ ID NO: 849, SEQ ID NO: 852, any one of SEQ ID NO: 903-SEQ ID NO: 914, any one of SEQ ID NO: 927-SEQ ID NO: 948, and active fragments thereof.

Methods for design and construction of fusion proteins (and polynucleotides encoding same) are known to those of skill in the art. Polynucleotides encoding a PIP-72 polypeptide may be fused to signal sequences which will direct the localization of the PIP-72 polypeptide to particular compartments of a prokaryotic or eukaryotic cell and/or direct the secretion of the PIP-72 polypeptide of the embodiments from a prokaryotic or eukaryotic cell. For example, in *E. coli*, one may wish to direct the expression of the protein to the periplasmic space. Examples of signal sequences or proteins (or fragments thereof) to which the PIP-72 polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs® (240 County Road, Ipswich, Mass. 01938-2723). In a specific embodiment, the PIP-72 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art (see, U.S. Pat. No. 7,193,133). Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the PIP-72 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine codon of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9.

In some embodiments fusion proteins are provide comprising a PIP-72 polypeptide, and an insecticdal polypeptide joined by an amino acid linker.

In some embodiments fusion proteins are provided represented by a formula selected from the group consisting of:
$R^1$-L-$R^2$, $R^2$-L-$R^1$, $R^1$-$R^2$ or $R^2$-$R^1$
wherein $R^1$ is a PIP-72 polypeptide or the polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945, or SEQ ID NO: 946, $R^2$ is an insecticidal polypeptide. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pill protein of the filamentous bacteriophages, e.g. bacteriophages M13 or fd (Schaller, et al., 1975). This region provides a long, flexible spacer region between two domains of the pill surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids EEKKN (SEQ ID NO: 488) from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

In another aspect chimeric PIP-72 polypeptides are provided that are created through joining two or more portions of PIP-72 genes, which originally encoded separate PIP-72 proteins to create a chimeric gene. The translation of the chimeric gene results in a single chimeric PIP-72 polypeptide with regions, motifs or domains derived from each of the original polypeptides. In certain embodiments the chimeric protein comprises portions, motifs or domains of PIP-72Aa (SEQ ID NO: 2), PIP-72Ba (SEQ ID NO: 4), PIP-72Ca (SEQ ID NO: 6) and PIP-72Cb (SEQ ID NO: 8), PIP-72 Da (SEQ ID NO: 10), PIP-72Db (SEQ ID NO: 12), PIP-72Dc (SEQ ID NO: 14), PIP-72Fa (SEQ ID NO: 18), PIP-72Ff (SEQ ID NO: 28) and PIP-72Gb (SEQ ID NO: 32), PIP-72Ab (SEQ ID NO: 927), PIP-72Bb (SEQ ID NO: 928), PIP-72Fh (SEQ ID NO: 932), PIP-72Fi (SEQ ID NO: 933), PIP-72Fj (SEQ ID NO: 934), PIP-72Fk (SEQ ID NO: 935), PIP-72Fl (SEQ ID NO: 936), PIP-72Gg (SEQ ID NO: 939), PIP-72Gh (SEQ ID NO: 940), PIP-72Gi (SEQ ID NO: 941), PIP-72Gk (SEQ ID NO: 943), PIP-72Gl (SEQ ID NO: 944), PIP-72Gm (SEQ ID NO: 945) or PIP-72Gn (SEQ ID NO: 946) in any combination.

It is recognized that DNA sequences may be altered by various methods, and that these alterations may result in DNA sequences encoding proteins with amino acid sequences different than that encoded by the wild-type (or native) pesticidal protein. In some embodiments a PIP-72 polypeptide may be altered in various ways including amino acid substitutions, deletions, truncations and insertions of one or more amino acids, including up to 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45 or more amino acid substitutions, deletions and/or insertions or combinations thereof compared to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, SEQ ID NO: 846, SEQ ID NO: 847, SEQ ID NO: 848, SEQ ID NO: 849, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945, or SEQ ID NO: 946.

Methods for such manipulations are generally known in the art. For example, amino acid sequence variants of a PIP-72 polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of a PIP-72 polypeptide to confer pesticidal activity may be improved by the use of such techniques upon the compositions of this disclosure.

For example, conservative amino acid substitutions may be made at one or more, predicted, nonessential amino acid residues. A "nonessential" amino acid residue is a residue that can be altered from the wild-type sequence of a PIP-72 polypeptide without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologs). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment of the homologs). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, one or more different PIP-72 polypeptide coding regions can be used to create a new PIP-72 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered PIP-72 polypeptides. Domains may be swapped between PIP-72 polypeptides, resulting in hybrid or chimeric toxins with improved insecticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Both DNA shuffling and site-directed mutagenesis were used to define polypeptide sequences that possess pesticidal activity. In Examples 8 & 9 DNA shuffling was used to generate a library of active variants by recombination of the diversity present in GBP_A3175 (SEQ ID NO: 20) and PIP-72 Da (SEQ ID NO: 10). The person skilled in the art will be able to use comparisons to other proteins or functional assays to further define motifs. High throughput screening can be used to test variations of those motifs to determine the role of specific residues. Given that knowledge for several motifs, one can then define the requirements for a functional protein. Knowledge of the motifs allows the skilled artisan to design sequence variations that would not impact function.

Alignment of homologs of PIP-72 homologs (FIGS. 1, 2, 3, 4 & 5) allowed identification of residues that are conserved among homologs in this family (FIG. 1). In Example 10 and 11, saturation mutagenesis was used to make and test substitutions at selected amino acid positions. These mutants were tested for activity and a number of active substitutions not present among the homologues were identified providing an understanding of the functional constraints at these residues.

In some embodiments polypeptides are provided comprising an amino acid sequence having at least 75%, at least 80%, at least 85%, at least 90%, at least 95% or greater sequence identity to the amino acid sequence set forth in SEQ ID NO: 20, SEQ ID NO: 24 SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948, wherein the polypeptide has insecticidal activity.

Compositions

Compositions comprising a PIP-72 polypeptide are also embraced. In some embodiments the composition comprises a PIP-72 polypeptide. In some embodiments the composition comprises a PIP-72 fusion protein.

Antibodies

Antibodies to a PIP-72 polypeptide of the embodiments or to variants or fragments thereof are also encompassed. The antibodies of the disclosure include polyclonal and monoclonal antibodies as well as fragments thereof which retain their ability to bind to PIP-72 proteins found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present disclosure are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. PIP-72 polypeptide polypeptide antibodies or antigen-binding portions thereof can be produced by a variety of techniques, including conventional monoclonal antibody methodology, for example the standard somatic cell hybridization technique of Kohler and Milstein, (1975) *Nature* 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing a PIP-72 polypeptide polypeptide as antigens.

A kit for detecting the presence of a PIP-72 polypeptide polypeptide or detecting the presence of a nucleotide sequence encoding a PIP-72 polypeptide polypeptide, in a sample is provided. In one embodiment, the kit provides antibody-based reagents for detecting the presence of a PIP-72 polypeptide polypeptide in a tissue sample. In another embodiment, the kit provides labeled nucleic acid probes useful for detecting the presence of one or more polynucleotides encoding PIP-72 polypeptide(s). The kit is provided along with appropriate reagents and controls for carrying out a detection method, as well as instructions for use of the kit.

Receptor Identification and Isolation

Receptors to the PIP-72 polypeptide of the embodiments or to variants or fragments thereof, are also encompassed. Methods for identifying receptors are well known in the art (see, Hofmann, et. al., (1988) *Eur. J. Biochem.* 173:85-91; Gill, et al., (1995) *J. Biol. Chem.* 27277-27282) can be employed to identify and isolate the receptor that recognizes the PIP-72 polypeptides using the brush-border membrane vesicles from susceptible insects. In addition to the radioactive labeling method listed in the cited literatures, PIP-72 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled PIP-72 polypeptides can be incubated with blotted membrane of BBMV and labeled the PIP-72 polypeptides can be identified with the labeled reporters. Identification of protein band(s) that interact with the PIP-72 polypeptides can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the PIP-72 polypeptides. Receptor function for insecticidal activity by the PIP-72 polypeptides can be verified by accomplished by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

In some embodiments the DNA construct comprises a polynucleotide encoding a PIP-72 polypeptide of the embodiments operably linked to a heterologous regulatory sequence.

In some embodiments the DNA construct comprises a polynucleotide encoding a polypeptide having at least 80%, 81%, 82%, 83%, 84%, 85%, 86%, 87%, 88%, 89%, 90%, 91%, 92%, 93%, 94%, 95%, 96%, 97%, 98%, 99% or greater sequence identity to the amino acid sequence of SEQ ID NO: 20, SEQ ID NO: 22, SEQ ID NO: 24, SEQ ID NO: 26, SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948, operably linked to a heterologous regulatory sequence.

In some embodiments the DNA construct comprises a polynucleotide encoding a polypeptide comprising amino acid sequence of SEQ ID NO: 20, SEQ ID NO: 22, SEQ ID NO: 24, SEQ ID NO: 26, SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948 operably linked to a heterologous regulatory sequence.

Such a DNA construct is provided with a plurality of restriction sites for insertion of the PIP-72 polypeptide gene sequence to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464; Christensen and Quail (1996) *Transgenic Res.* 5:213-218; Christensen et al. (1992) *Plant Molecular Biology* 18:675-689)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96), the maize Adh1 intron (Kyozuka et al. (1991) *Mol. Gen. Genet.* 228:40-48; Kyozuka et al. (1990) *Maydica* 35:353-357), the enhancers of U.S. Pat. No. 7,803,992, and the sugarcane bacilliform viral (SCBV) enhancer of WO2013130813 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guer- usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, and Liu H et al. *Mol Bio Rep* 37:677-684, 2010, herein incorporated by reference. A *Zea* maize codon usage table can be also found at kazusa.or.jp/codon/cgi-bin/showcodon.cgi?species=4577, which can be accessed using the www prefix. Table 2 shows a maize optimal codon analysis (adapted from Liu H et al. *Mol Bio Rep* 37:677-684, 2010).

TABLE 2

| Amino Acid | Codon | High Count | RSCU | Low Count | RSCU | Amino Acid | Codon | High Count | RSCU | Low Count | RSCU |
|---|---|---|---|---|---|---|---|---|---|---|---|
| Phe | UUU | 115 | 0.04 | 2,301 | 1.22 | Ala | GCU | 629 | 0.17 | 3,063 | 1.59 |
|  | UUC* | 5,269 | 1.96 | 1,485 | 0.78 |  | GCC* | 8,057 | 2.16 | 1,136 | 0.59 |
| Ser | UCU | 176 | 0.13 | 2,498 | 1.48 |  | GCA | 369 | 0.1 | 2,872 | 1.49 |
|  | UCC* | 3,489 | 2.48 | 1,074 | 0.63 |  | GCG* | 5,835 | 1.57 | 630 | 0.33 |
|  | UCA | 104 | 0.07 | 2,610 | 1.54 | Tyr | UAU | 71 | 0.04 | 1,632 | 1.22 |
|  | UCG* | 1,975 | 1.4 | 670 | 0.4 |  | UAC* | 3,841 | 1.96 | 1,041 | 0.78 |
|  | AGU | 77 | 0.05 | 1,788 | 1.06 | His | CAU | 131 | 0.09 | 1,902 | 1.36 |
|  | AGC* | 2,617 | 1.86 | 1,514 | 0.89 |  | CAC* | 2,800 | 1.91 | 897 | 0.64 |
| Leu | UUA | 10 | 0.01 | 1,326 | 0.79 | Cys | UGU | 52 | 0.04 | 1,233 | 1.12 |
|  | UUG | 174 | 0.09 | 2,306 | 1.37 |  | UGC* | 2,291 | 1.96 | 963 | 0.88 |
|  | CUU | 223 | 0.11 | 2,396 | 1.43 | Gln | CAA | 99 | 0.05 | 2,312 | 1.04 |
|  | CUC* | 5,979 | 3.08 | 1,109 | 0.66 |  | CAG* | 3,557 | 1.95 | 2,130 | 0.96 |
|  | CUA | 106 | 0.05 | 1,280 | 0.76 | Arg | CGU | 153 | 0.12 | 751 | 0.74 |
|  | CUG* | 5,161 | 2.66 | 1,646 | 0.98 |  | CGC* | 4,278 | 3.25 | 466 | 0.46 |
| Pro | CCU | 427 | 0.22 | 1,900 | 1.47 |  | CGA | 92 | 0.07 | 659 | 0.65 |
|  | CCC* | 3,035 | 1.59 | 601 | 0.47 |  | CGG* | 1,793 | 1.36 | 631 | 0.62 |
|  | CCA | 311 | 0.16 | 2,140 | 1.66 |  | AGA | 83 | 0.06 | 1,948 | 1.91 |
|  | CCG* | 3,846 | 2.02 | 513 | 0.4 |  | AGG* | 1,493 | 1.14 | 1,652 | 1.62 |
| Ile | AUU | 138 | 0.09 | 2,388 | 1.3 | Asn | AAU | 131 | 0.07 | 3,074 | 1.26 |
|  | AUC* | 4,380 | 2.85 | 1,353 | 0.74 |  | AAC* | 3,814 | 1.93 | 1,807 | 0.74 |
|  | AUA | 88 | 0.06 | 1,756 | 0.96 | Lys | AAA | 130 | 0.05 | 3,215 | 0.98 |
| Thr | ACU | 136 | 0.09 | 1,990 | 1.43 |  | AAG* | 5,047 | 1.95 | 3,340 | 1.02 |
|  | ACC* | 3,398 | 2.25 | 991 | 0.71 | Asp | GAU | 312 | 0.09 | 4,217 | 1.38 |
|  | ACA | 133 | 0.09 | 2,075 | 1.5 |  | GAC* | 6,729 | 1.91 | 1,891 | 0.62 |
|  | ACG* | 2,378 | 1.57 | 495 | 0.36 | Gly | GGU | 363 | 0.13 | 2,301 | 1.35 |
| Val | GUU | 182 | 0.07 | 2,595 | 1.51 |  | GGC* | 7,842 | 2.91 | 1,282 | 0.75 |
|  | GUC* | 4,584 | 1.82 | 1,096 | 0.64 |  | GGA | 397 | 0.15 | 2,044 | 1.19 |
|  | GUA | 74 | 0.03 | 1,325 | 0.77 |  | GGG* | 2,186 | 0.81 | 1,215 | 0.71 |
|  | GUG* | 5,257 | 2.08 | 1,842 | 1.07 | Glu | GAA | 193 | 0.06 | 4,080 | 1.1 |
|  |  |  |  |  |  |  | GAG* | 6,010 | 1.94 | 3,307 | 0.9 |

Codon usage was compared using Chi squared contingency test to identify optimal codons.
Codons that occur significantly more often (P\0.01) are indicated with an asterisk.

ineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon A *Glycine max* codon usage table is shown in Table 3 and can also be found at kazusa.or.jp/codon/cgi-bin/showcodon.cgi?species=3847&aa=1 &style=N, which can be accessed using the www prefix.

TABLE 3

| TTT | F | 21.2 | (10493) | TCT | S | 18.4 | (9107) |
|---|---|---|---|---|---|---|---|
| TTC | F | 21.2 | (10487) | TCC | S | 12.9 | (6409) |
| TTA | L | 9.2 | (4545) | TCA | S | 15.6 | (7712) |
| TTG | L | 22.9 | (11340) | TCG | S | 4.8 | (2397) |
| CTT | L | 23.9 | (11829) | CCT | P | 18.9 | (9358) |
| CTC | L | 17.1 | (8479) | CCC | P | 10.1 | (5010) |
| CTA | L | 8.5 | (4216) | CCA | P | 19.1 | (9461) |
| CTG | L | 12.7 | (6304) | CCG | P | 4.7 | (2312) |
| ATT | I | 25.1 | (12411) | ACT | T | 17.1 | (8490) |
| ATC | I | 16.3 | (8071) | ACC | T | 14.3 | (7100) |
| ATA | I | 12.9 | (6386) | ACA | T | 14.9 | (7391) |
| ATG | M | 22.7 | (11218) | ACG | T | 4.3 | (2147) |
| GTT | V | 26.1 | (12911) | GCT | A | 26.7 | (13201) |
| GTC | V | 11.9 | (5894) | GCC | A | 16.2 | (8026) |
| GTA | V | 7.7 | (3803) | GCA | A | 21.4 | (10577) |
| GTG | V | 21.4 | (10610) | GCG | A | 6.3 | (3123) |
| TAT | Y | 15.7 | (7779) | TGT | C | 8.1 | (3995) |

TABLE 3-continued

| | | | | | | | |
|---|---|---|---|---|---|---|---|
| TAC | Y | 14.9 | (7367) | TGC | C | 8.0 | (3980) |
| TAA | * | 0.9 | (463) | TGA | * | 1.0 | (480) |
| TAG | * | 0.5 | (263) | TGG | W | 13.0 | (6412) |
| CAT | H | 14.0 | (6930) | CGT | R | 6.6 | (3291) |
| CAC | H | 11.6 | (5759) | CGC | R | 6.2 | (3093) |
| CAA | Q | 20.5 | (10162) | CGA | R | 4.1 | (2018) |
| CAG | Q | 16.2 | (8038) | CGG | R | 3.1 | (1510) |
| AAT | N | 22.4 | (11088) | AGT | S | 12.6 | (6237) |
| AAC | N | 22.8 | (11284) | AGC | S | 11.3 | (5594) |
| AAA | K | 26.9 | (13334) | AGA | R | 14.8 | (7337) |
| AAG | K | 35.9 | (17797) | AGG | R | 13.3 | (6574) |
| GAT | D | 32.4 | (16040) | GGT | G | 20.9 | (10353) |
| GAC | D | 20.4 | (10097) | GGC | G | 13.4 | (6650) |
| GAA | E | 33.2 | (16438) | GGA | G | 22.3 | (11022) |
| GAG | E | 33.2 | (16426) | GGG | G | 13.0 | (6431) |

In some embodiments the recombinant nucleic acid molecule encoding a PIP-72 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are protolytically activated in the gut of the target pest (Chang, (1987) *Methods Enzymol.* 153:507-516). In some embodiments, the signal sequence is located in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. Plant Cell 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research*, 78:249-264, 2003. In particular, Table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) are well known to one skilled in the art also include chimeric CTPs comprising but not limited to, an N-terminal domain, a central domain or a C-terminal domain from a CTP from *Oryza sativa* 1-deoxy-D xyulose-5-Phosphate Synthase *Oryza sativa*-Superoxide dismutase *Oryza sativa*-soluble starch synthase *Oryza sativa*-NADP-dependent Malic acid enzyme *Oryza sativa*-Phospho-2-dehydro-3-deoxyheptonate Aldolase 2 *Oryza sativa*-L-Ascorbate peroxidase 5 *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type (US Patent Application Publication 2012/0304336). Chloroplast transit peptides of US Patent Publications US20130205440A1, US20130205441A1 and US20130210114A1.

The PIP-72 polypeptide gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Promoters of the present invention include homologues of cis elements known to effect gene regulation that show homology with the promoter sequences of the present invention. These cis elements include, but are not limited to, oxygen responsive cis elements (Cowen et al., J Biol. Chem. 268(36):26904-26910 (1993)), light regulatory elements (Bruce and Quaill, Plant Cell 2 (11):1081-1089 (1990); Bruce et al., EMBO J. 10:3015-3024 (1991); Rocholl et al., Plant Sci. 97:189-198 (1994); Block et al., Proc. Natl. Acad. Sci. USA 87:5387-5391 (1990); Giuliano et al., Proc. Natl. Acad. Sci. USA 85:7089-7093 (1988); Staiger et al., Proc. Natl. Acad. Sci. USA 86:6930-6934 (1989); Izawa et al., Plant Cell 6:1277-1287 (1994); Menkens et al., Trends in Biochemistry 20:506-510 (1995); Foster et al., FASEB J. 8:192-200 (1994); Plesse et al., Mol Gen Gene 254:258-266 (1997); Green et al., EMBO J. 6:2543-2549 (1987); Kuhlemeier et al., Ann. Rev Plant Physiol. 38:221-257 (1987); Villain et al., J. Biol. Chem. 271:32593-32598 (1996); Lam et al., Plant Cell 2:857-866 (1990); Gilmartin et al., Plant Cell 2:369-378 (1990); Datta et al., Plant Cell 1:1069-1077 (1989); Gilmartin et al., Plant Cell 2:369-378 (1990); Castresana et al., EMBO J. 7:1929-1936 (1988); Ueda et al., Plant Cell 1:217-227 (1989); Terzaghi et al., Annu. Rev. Plant Physiol. Plant Mol. Biol. 46:445-474 (1995); Green et al., EMBO J. 6:2543-2549 (1987); Villain et al., J. Biol. Chem. 271:32593-32598 (1996); Tjaden et al., Plant Cell 6:107-118 (1994); Tjaden et al., Plant Physiol. 108:1109-1117 (1995); Ngai et al., Plant J. 12:1021-1234 (1997); Bruce et al., EMBO J. 10:3015-3024 (1991); Ngai et al., Plant J. 12:1021-1034 (1997)), elements responsive to gibberellin, (Muller et al., J. Plant Physiol. 145:606-613 (1995); Croissant et al., Plant Science 116:27-35 (1996); Lohmer et al., EMBO J. 10:617-624 (1991); Rogers et al., Plant Cell 4:1443-1451 (1992); Lanahan et al., Plant Cell 4:203-211 (1992); Skriver et al., Proc. Natl. Acad. Sci. USA 88:7266-7270 (1991); Gilmartin et al., Plant Cell 2:369-378 (1990); Huang et al., Plant Mol. Biol. 14:655-668 (1990), Gubler et al., Plant Cell 7:1879-1891 (1995)), elements responsive to abscisic acid, (Busk et al., Plant Cell 9:2261-2270 (1997); Guiltinan et al., Science 250:267-270 (1990); Shen et al., Plant Cell 7:295-307 (1995); Shen et al., Plant Cell 8:1107-1119 (1996); Seo et al., Plant Mol. Biol. 27:1119-1131 (1995); Marcotte et al., Plant Cell 1:969-976 (1989); Shen et al., Plant Cell 7:295-307 (1995); Iwasaki et al., Mol Gen Genet 247:391-398 (1995); Hattori et al., Genes Dev. 6:609-618 (1992); Thomas et al., Plant Cell 5:1401-1410 (1993)), elements similar to abscisic acid responsive elements, (Ellerstrom et al., Plant Mol. Biol. 32:1019-1027 (1996)), auxin responsive elements (Liu et al., Plant Cell 6:645-657 (1994); Liu et al., Plant Physiol. 115:397-407 (1997); Kosugi et al., Plant J. 7:877-886 (1995); Kosugi et al., Plant Cell 9:1607-1619 (1997); Ballas et al., J. Mol. Biol. 233:580-596 (1993)), a cis element responsive to methyl jasmonate treatment (Beaudoin and Rothstein, Plant Mol. Biol. 33:835-846 (1997)), a cis element responsive to abscisic acid and stress response (Straub et al., Plant Mol. Biol. 26:617-630 (1994)), ethylene responsive cis elements (Itzhaki et al., Proc. Natl. Acad. Sci. USA 91:8925-8929 (1994); Montgomery et al., Proc. Natl. Acad. Sci. USA 90:5939-5943 (1993); Sessa et al., Plant Mol. Biol. 28:145-153 (1995); Shinshi et al., Plant Mol. Biol. 27:923-932 (1995)), salicylic acid cis responsive elements, (Strange et al., Plant J. 11:1315-1324 (1997); Qin et al., Plant Cell 6:863-874 (1994)), a cis element that responds to water stress and abscisic acid (Lam et al., J. Biol. Chem. 266:17131-17135 (1991); Thomas et al., Plant Cell 5:1401-1410 (1993); Pla et al., Plant Mol Biol 21:259-266 (1993)), a cis element essential for M phase-specific expression (Ito et al., Plant Cell 10:331-341 (1998)), sucrose responsive elements (Huang et al., Plant Mol. Biol. 14:655-668 (1990); Hwang et al., Plant Mol Biol 36:331-341 (1998); Grierson et al., Plant J. 5:815-826 (1994)), heat shock response elements (Pelham et al., Trends Genet. 1:31-35 (1985)), elements responsive to auxin and/or salicylic acid and also reported for light regulation (Lam et al., Proc. Natl. Acad. Sci. USA 86:7890-7897 (1989); Benfey et al., Science 250:959-966 (1990)), elements responsive to ethylene and salicylic acid (Ohme-Takagi et al., Plant Mol. Biol. 15:941-946 (1990)), elements responsive to wounding and abiotic stress (Loake et al., Proc. Natl. Acad. Sci. USA 89:9230-9234 (1992); Mhiri et al., Plant Mol. Biol. 33:257-266 (1997)), antioxidant response elements (Rushmore et al., J. Biol. Chem. 266:11632-11639; Dalton et al., Nucleic Acids Res. 22:5016-5023 (1994)), Sph elements (Suzuki et al., Plant Cell 9:799-807 1997)), elicitor responsive elements, (Fukuda et al., Plant Mol. Biol. 34:81-87 (1997); Rushton et al., EMBO J. 15:5690-5700 (1996)), metal responsive elements (Stuart et al., Nature 317:828-831 (1985); Westin et al., EMBO J. 7:3763-3770 (1988); Thiele et al., Nucleic Acids Res. 20:1183-1191 (1992); Faisst et al., Nucleic Acids Res. 20:3-26 (1992)), low temperature responsive elements, (Baker et al., Plant Mol. Biol. 24:701-713 (1994); Jiang et al., Plant Mol. Biol. 30:679-684 (1996); Nordin et al., Plant Mol. Biol. 21:641-653 (1993); Zhou et al., J. Biol. Chem. 267:23515-23519 (1992)), drought responsive elements, (Yamaguchi et al., Plant Cell 6:251-264 (1994); Wang et al., Plant Mol. Biol. 28:605-617 (1995); Bray E A, Trends in Plant Science 2:48-54 (1997)) enhancer elements for glutenin, (Colot et al., EMBO J. 6:3559-3564 (1987); Thomas et al., Plant Cell 2:1171-1180 (1990); Kreis et al., Philos. Trans. R. Soc. Lond., B314:355-365 (1986)), light-independent regulatory elements, (Lagrange et al., Plant Cell 9:1469-1479 (1997); Villain et al., J. Biol. Chem. 271:32593-32598 (1996)), OCS enhancer elements, (Bouchez et al., EMBO J. 8:4197-4204 (1989); Foley et al., Plant J. 3:669-679 (1993)), ACGT elements, (Foster et al., FASEB J. 8:192-200 (1994); Izawa et al., Plant Cell 6:1277-1287 (1994); Izawa et al., J. Mol. Biol. 230:1131-1144 (1993)), negative cis elements in plastid related genes, (Zhou et al., J. Biol. Chem. 267:23515-23519 (1992); Lagrange et al., Mol. Cell Biol. 13:2614-2622 (1993); Lagrange et al., Plant Cell 9:1469-1479 (1997); Zhou et al., J. Biol. Chem. 267:23515-23519 (1992)), prolamin box elements, (Forde et al., Nucleic Acids Res. 13:7327-7339 (1985); Colot et al., EMBO J. 6:3559-3564 (1987); Thomas et al., Plant Cell 2:1171-1180 (1990); Thompson et al., Plant Mol. Biol. 15:755-764 (1990); Vicente et al., Proc. Natl. Acad. Sci. USA 94:7685-7690 (1997)), elements in enhancers from the IgM heavy chain gene (Gillies et al., Cell 33:717-728 (1983); Whittier et al., Nucleic Acids Res. 15:2515-2535 (1987)). Examples of promoters include: those described in U.S. Pat. No. 6,437,217 (maize RS81 promoter), U.S. Pat. No. 5,641,876 (rice actin promoter), U.S. Pat. No. 6,426,446 (maize RS324 promoter), U.S. Pat. No. 6,429,362 (maize PR-1 promoter), U.S. Pat. No. 6,232,526 (maize A3 promoter), U.S. Pat. No. 6,177,611 (constitutive maize promoters), U.S. Pat. Nos. 5,322,938, 5,352,605, 5,359,142 and 5,530,196 (35S promoter), U.S. Pat. No. 6,433,252 (maize L3 oleosin promoter, P-Zm.L3), U.S. Pat. No. 6,429,357

(rice actin 2 promoter as well as a rice actin 2 intron), U.S. Pat. No. 5,837,848 (root specific promoter), U.S. Pat. No. 6,294,714 (light inducible promoters), U.S. Pat. No. 6,140,078 (salt inducible promoters), U.S. Pat. No. 6,252,138 (pathogen inducible promoters), U.S. Pat. No. 6,175,060 (phosphorus deficiency inducible promoters), U.S. Pat. No. 6,635,806 (gama-coixin promoter, P-CI.Gcx), U.S. patent application Ser. No. 09/757,089 (maize chloroplast aldolase promoter), and U.S. Pat. No. 8,772,466 (maize transcription factor Nuclear Factor B (NFB2)).

Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611. Suitable constitutive promoters also include promoters that have strong expression in nearly all tissues but have low expression in pollen, including but not limited to: Banana Streak Virus (*Acuminata Yunnan*) promoters (BSV(AY)) disclosed in US patent U.S. Pat. No. 8,338,662; Banana Streak Virus (*Acuminata Vietnam*) promoters (BSV(AV)) disclosed in US patent U.S. Pat. No. 8,350,121; and Banana Streak Virus (Mysore) promoters (BSV(MYS)) disclosed in US patent U.S. Pat. No. 8,395,022.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4:645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced PIP-72 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7):792-803; Hansen, et al., (1997) *Mol. Gen Genet.* 254(3):337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5):773-778; Lam, (1994) *Results Probl. Cell Differ.* 20:181-196; Orozco, et al., (1993) *Plant Mol Biol.* 23(6):1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, Plant Science (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US Patent Application US20130117883. Root-preferred *sorghum* (*Sorghum bicolor*) RCc3 promoters are disclosed in US Patent Application US20120210463. The root-preferred maize promoters of US Patent Application Publication 20030131377, U.S. Pat. Nos. 7,645,919, and 8,735,655. The root cap-specific 1 (ZmRCP1) maize promoters of US Patent Application Publication 20130025000. The root-preferred maize promoters of US Patent Application Publication 20130312136.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608, 144; 5,604,121; 5,569,597; 5,466,785; 5,399,680; 5,268, 463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbio.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248: 480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551;

Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods, ed.* Gamborg and Phillips, (Springer-Verlag, Berlin) and McCabe, et al., (1988) *Biotechnology* 6:923-926) and Lec1 transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, N.Y.), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the PIP-72 polypeptide or variants and fragments thereof directly into the plant or the introduction of the PIP-72 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107: 775-784, all of which are herein incorporated by reference. Alternatively, the PIP-72 polypeptide polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired PIP-72 polypeptide. It is also recognized that such a viral polyprotein, comprising at least a portion of the amino acid sequence of a PIP-72 polypeptide of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea*

*americana*), fig (*Ficus casica*), guava (*Psidium guajava*), mango (*Mangifera indica*), olive (*Olea europaea*), *papaya* (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotil*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, *sorghum*, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithi*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, *sorghum*, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mungbean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the PIP-72 polypeptide.

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the PIP-72 polypeptides disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:

1. Transgenes that Confer Resistance to Insects or Disease and that Encode:

(A) plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262: 1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens*, 7:1-13), from *Pseudomonas protegens* strain CHA0 and Pf-5 (previously *fluorescens*) (Pechy-Tarr, (2008) *Environmental Microbiology* 10:2368-2386: GenBank Accession No. EU400157); from *Pseudomonas Taiwanensis* (Liu, et al., (2010) *J. Agric. Food Chem.* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. Nos. 6,048,838, and 6,379, 946; a PIP-1 polypeptide of U.S. Ser. No. 13/792,861; an AfIP-1A and/or AfIP-1B polypeptides of U.S. Ser. No. 13/800,233; a PHI-4 polypeptide of U.S. Ser. No. 13/839, 702; PIP-47 polypeptides of U.S. Ser. No. 61/866,747; the insecticidal proteins of U.S. Ser. Nos. 61/863,761 and 61/863763; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51, Cry52, Cry 53, Cry 54, Cry55, Cry56, Cry57, Cry58, Cry59. Cry60, Cry61, Cry62, Cry63, Cry64, Cry65, Cry66, Cry67, Cry68, Cry69, Cry70 and Cry71 classes of δ-endotoxin genes and the *B. thuringiensis* cytolytic Cyt1 and Cyt2 genes. Members of these classes of *B. thuringiensis* insecticidal proteins include, but are not limited to Cry1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession # AAA86265); Cry1Aa7 (Accession # AAD46139); Cry1Aa8 (Accession #I26149); Cry1Aa9 (Accession # BAA77213); Cry1Aa10 (Accession # AAD55382); Cry1Aa11 (Accession # CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession #I12419); Cry1Ab12 (Accession # AAC64003); Cry1Ab13 (Accession # AAN76494); Cry1Ab14 (Accession # AAG16877); Cry1Ab15 (Accession # AAO13302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession

HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession #I12418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession # FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AAO39719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # AB020894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AAO39720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1](Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession #I76415); Cry1Da3 (Accession # HQ439784); Cry1Db1 (Accession # CAA80234); Cry1 Db2 (Accession # AAK48937); Cry1 Dc1 (Accession # ABK35074); Cry1Ea1 (Accession # CAA37933); Cry1Ea2 (Accession # CAA39609); Cry1Ea3 (Accession # AAA22345); Cry1Ea4 (Accession # AAD04732); Cry1Ea5 (Accession # A15535); Cry1Ea6 (Accession # AAL50330); Cry1Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1 Fb2 (Accession # BAA25298); Cry1 Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AAO13756); Cry1Gc1 (Accession # AAQ52381); Cry1 Ha1 (Accession # CAA80236); Cry1 Hb1 (Accession # AAA79694); Cry1 Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib12 (Accession # ABW88019); Cry1Ib13 (Accession # ACD75515); Cry1Ib14 (Accession # HM051227); Cry1Ib15 (Accession # HM070028); Cry1Ib16 (Accession # ADK38579); Cry1Ib17 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1 dl (Accession # AAD44366); Cry1Id2 (Accession # JQ228422); Cry1Ie1 (Accession # AAG43526); Cry1Ie2 (Accession # HM439636); Cry1Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession # ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1 Ka1 (Accession # AAB00376); Cry1 Ka2 (Accession #

HQ439783); Cry1La1 (Accession # AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession # AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # AB183671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession # JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CAO78739); Cry2Ae1 (Accession # AAQ52362); Cry2Af1 (Accession # AB030519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession #I15475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession #I34543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # ACI44005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession #

HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession #I32932); Cry21Aa2 (Accession #I66477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession #I34547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # ACI22625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BA144026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BA144022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # KC156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession # KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676); Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545);

Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # AB114444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession # ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EAO57254); Cry60Aa3 (Accession # EEM99278); Cry60Ba1 (Accession # GU810818); Cry60Ba2 (Accession # EAO57253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509); Cry63Aa1 (Accession # BA144028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession # ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # ADO51070); Cry70Bb1 (Accession # EEL67276); Cry71Aa1 (Accession # JX025568); Cry72Aa1 (Accession # JX025569).

Examples of δ-endotoxins also include but are not limited to Cry1A proteins of U.S. Pat. Nos. 5,880,275, 7,858,849 8,530,411, 8,575,433, and 8,686,233; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families, including but not limited to the Cry9D protein of U.S. Pat. No. 8,802,933 and the Cry9B protein of U.S. Pat. No. 8,802,934; a Cry15 protein of Naimov, et al., (2008) *Applied and Environmental Microbiology,* 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US Patent Application Publication Number 2008/0295207; ET29, ET37, TIC809, TIC810, TIC812, TIC127, TIC128 of PCT US 2006/033867; TIC853 toxins of U.S. Pat. No. 8,513,494, AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247 and U.S. Pat. No. 8,759,619; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent Application Publication Number 2010/0005543, AXMI270 of US Patent Application Publication US20140223598, AXMI279 of US Patent Application Publication US20140223599, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database, which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); Cry1Ab & Cry1F (US20140182018); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC® under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum*.

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876 B1; 6,040,497; 5,804,425; 5,633,435; 5,145,783; 4,971,908; 5,312,910; 5,188,642; 5,094,945, 4,940,835; 5,866,775; 6,225,114 B1; 6,130,366; 5,310,667; 4,535,060; 4,769,061; 5,633,448; 5,510,471; Re. 36,449; RE 37,287 E and 5,491,288 and International Publications EP 1173580; WO 2001/66704; EP 1173581 and EP 1173582, which are incorporated herein by reference for this purpose. Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC® Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al., De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550,318; 5,874,265; 5,919,675; 5,561,236; 5,648,477; 5,646,024; 6,177,616 B1 and 5,879,903, which are incorporated herein by reference for this purpose. Exemplary genes conferring resistance to phenoxy proprionic acids and cyclohexones, such as sethoxydim and haloxyfop, are the Acc1-S1, Acc1-S2 and Acc1-S3 genes described by Marshall, et al., (1992) *Theor. Appl. Genet.* 83:435.

(C) A polynucleotide encoding a protein for resistance to herbicide that inhibits photosynthesis, such as a triazine (psbA and gs+ genes) and a benzonitrile (nitrilase gene). Przibilla, et al., (1991) *Plant Cell* 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC® Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (*Datta*, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306 B1; 6,282,837 B1 and 5,767,373 and International Publication WO 2001/12825.

(F) The aad-1 gene (originally from Sphingobium *herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtI) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic

Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, various Ipa genes such as Ipa1, Ipa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), *Primula* A6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. Nos. 6,197,561, 6,291,224, 6,391, 348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648. which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Segaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Refl, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that confers male fertility to be transcribed.

(A) Introduction of a deacetylase gene under the control of a tapetum-specific promoter and with the application of the chemical N—Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859,341; 6,297,426; 5,478,369; 5,824,524; 5,850,014 and 6,265,640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gln recombinase of phage Mu (Maeser, et al., (1991) Vicki Chandler, *The Maize Handbook* ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO 2000/060089, WO 2001/026459, WO 2001/035725, WO 2001/034726, WO 2001/035727, WO 2001/036444, WO 2001/036597, WO 2001/036598, WO 2002/015675, WO 2002/017430, WO 2002/077185, WO 2002/079403, WO 2003/013227, WO 2003/013228, WO 2003/014327, WO 2004/031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. Nos. 6,177,275 and 6,107,547 (enhancement of nitrogen utilization and altered nitrogen responsiveness).

(E) For ethylene alteration, see, US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

(Q) Expression of a nucleic acid sequence encoding a Drought Tolerant Phenotype (DTP6) polypeptide, specifically AT-DTP6 of US Patent Application Publication Number US-2014/0223595.

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. Nos. 6,794,560, 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events in Table 4A-4F.

TABLE 4A

| Oryza sativa Rice | | |
|---|---|---|
| Event | Company | Description |
| CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). |
| IMINTA-1, IMINTA-4 | BASF Inc. | Tolerance to imidazolinone herbicides induced by chemical mutagenesis of the acetolactate synthase (ALS) enzyme using sodium azide. |
| LLRICE06, LLRICE62 | Aventis CropScience | Glufosinate ammonium herbicide tolerant rice produced by inserting a modified phosphinothricin acetyltransferase (PAT) encoding gene from the soil bacterium *Streptomyces hygroscopicus*). |
| LLRICE601 | Bayer CropScience (Aventis CropScience(AgrEvo)) | Glufosinate ammonium herbicide tolerant rice produced by inserting a modified phosphinothricin acetyltransferase (PAT) encoding gene from the soil bacterium *Streptomyces hygroscopicus*). |
| PWC16 | BASF Inc. | Tolerance to the imidazolinone herbicide, imazethapyr, induced by chemical mutagenesis of the acetolactate synthase (ALS) enzyme using ethyl methanesulfonate (EMS). |

TABLE 4B

| Medicago sativa Alfalfa | | |
|---|---|---|
| Event | Company | Description |
| J101, J163 | Monsanto Company and Forage Genetics International | Glyphosate herbicide tolerant alfalfa (lucerne) produced by inserting a gene encoding the enzyme 5-enolypyruvylshikimate-3-phosphate synthase (EPSPS) from the CP4 strain of *Agrobacterium tumefaciens*. |

TABLE 4C

| Triticum aestivum Wheat | | |
|---|---|---|
| Event | Company | Description |
| AP205CL | BASF Inc. | Selection for a mutagenized version of the enzyme acetohydroxyacid synthase (AHAS), also known as acetolactate synthase (ALS) or acetolactate pyruvate-lyase. |
| AP602CL | BASF Inc. | Selection for a mutagenized version of the enzyme acetohydroxyacid synthase (AHAS), also known as acetolactate synthase (ALS) or acetolactate pyruvate-lyase. |
| BW255-2, BW238-3 | BASF Inc. | Selection for a mutagenized version of the enzyme acetohydroxyacid synthase (AHAS), also known as acetolactate synthase (ALS) or acetolactate pyruvate-lyase. |
| BW7 | BASF Inc. | Tolerance to imidazolinone herbicides induced by chemical mutagenesis of the acetohydroxyacid synthase (AHAS) gene using sodium azide. |
| MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. |
| SWP965001 | Cyanamid Crop Protection | Selection for a mutagenized version of the enzyme acetohydroxyacid synthase (AHAS), also known as acetolactate synthase (ALS) or acetolactate pyruvate-lyase. |
| Teal 11A | BASF Inc. | Selection for a mutagenized version of the enzyme acetohydroxyacid synthase (AHAS), also known as acetolactate synthase (ALS) or acetolactate pyruvate-lyase. |

TABLE 4D

| | Helianthus annuus Sunflower | |
|---|---|---|
| Event | Company | Description |
| X81359 | BASF Inc. | Tolerance to imidazolinone herbicides by selection of a naturally occurring mutant. |

TABLE 4E

| | Glycine max L. Soybean | |
|---|---|---|
| Event | Company | Description |
| A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). |
| DP-305423 | Pioneer Hi-Bred International Inc. | High oleic acid soybean produced by inserting additional copies of a portion of the omega-6 desaturase encoding gene, gm-fad2-1 resulting in silencing of the endogenous omega-6 desaturase gene (FAD2-1). |
| DP356043 | Pioneer Hi-Bred International Inc. | Soybean event with two herbicide tolerance genes: glyphosate N-acetlytransferase, which detoxifies glyphosate, and a modified acetolactate synthase (ALS) gene which is tolerant to ALS-inhibiting herbicides. |
| G94-1, G94-19, G168 | DuPont Canada Agricultural Products | High oleic acid soybean produced by inserting a second copy of the fatty acid desaturase (Gm Fad2-1) encoding gene from soybean, which resulted in "silencing" of the endogenous host gene. |
| GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. |
| GU262 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| MON87701 | Monsanto Company | Resistance to Lepidopteran pests of soybean including velvetbean caterpillar (*Anticarsia gemmatalis*) and soybean looper (*Pseudoplusia includens*). |
| MON87701 × MON89788 | Monsanto Company | Glyphosate herbicide tolerance through expression of the EPSPS encoding gene from *A. tumefaciens* strain CP4, and resistance to Lepidopteran pests of soybean including velvetbean caterpillar (*Anticarsia gemmatalis*) and soybean looper (*Pseudoplusia includens*) via expression of the Cry1Ac encoding gene from *B. thuringiensis*. |
| MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. |
| OT96-15 | Agriculture & Agri-Food Canada | Low linolenic acid soybean produced through traditional cross-breeding to incorporate the novel trait from a naturally occurring fan1 gene mutant that was selected for low linolenic acid. |

TABLE 4E-continued

Glycine max L. Soybean

| Event | Company | Description |
|---|---|---|
| W62, W98 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces hygroscopicus*. |

TABLE 4F

Zea mays L. Maize

| Event | Company | Description |
|---|---|---|
| 176 | Syngenta Seeds, Inc. | Insect-resistant maize produced by inserting the Cry1Ab gene from *Bacillus thuringiensis* subsp. *kurstaki*. The genetic modification affords resistance to attack by the European corn borer (ECB). |
| 3751 IR | Pioneer Hi-Bred International Inc. | Selection of somaclonal variants by culture of embryos on imidazolinone containing media. |
| 676, 678, 680 | Pioneer Hi-Bred International Inc. | Male-sterile and glufosinate ammonium herbicide tolerant maize produced by inserting genes encoding DNA adenine methylase and phosphinothricin acetyltransferase (PAT) from *Escherichia coli* and *Streptomyces viridochromogenes*, respectively. |
| B16 (DLL25) | Dekalb Genetics Corporation | Glufosinate ammonium herbicide tolerant maize produced by inserting the gene encoding phosphinothricin acetyltransferase (PAT) from *Streptomyces hygroscopicus*. |
| BT11 (X4334CBR, X4734CBR) | Syngenta Seeds, Inc. | Insect-resistant and herbicide tolerant maize produced by inserting the Cry1Ab gene from *Bacillus thuringiensis* subsp. *kurstaki*, and the phosphinothricin N-acetyltransferase (PAT) encoding gene from *S. viridochromogenes*. |
| BT11 × GA21 | Syngenta Seeds, Inc. | Stacked insect resistant and herbicide tolerant maize produced by conventional cross breeding of parental lines BT11 (OECD unique identifier: SYN-BTO11-1) and GA21 (OECD unique identifier: MON-OOO21-9). |
| BT11 × MIR162 × MIR604 × GA21 | Syngenta Seeds, Inc. | Resistance to Coleopteran pests, particularly corn rootworm pests (*Diabrotica* spp.) and several Lepidopteran pests of corn, including European corn borer (ECB, *Ostrinia nubilalis*), corn earworm (CEW, *Helicoverpa zea*), fall army worm (FAW, *Spodoptera frugiperda*), and black cutworm (BCW, *Agrotis ipsilon*); tolerance to glyphosate and glufosinate-ammonium containing herbicides. |
| BT11 × MIR162 | Syngenta Seeds, Inc. | Stacked insect resistant and herbicide tolerant maize produced by conventional cross breeding of parental lines BT11 (OECD unique identifier: SYN-BTO11-1) and MIR162 (OECD unique identifier: SYN-1R162-4). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Resistance to other Lepidopteran pests, including *H. zea*, *S. frugiperda*, *A. ipsilon*, and *S. albicosta*, is derived from MIR162, which contains the vip3Aa gene from *Bacillus thuringiensis* strain AB88. |

TABLE 4F-continued

Zea mays L. Maize

| Event | Company | Description |
|---|---|---|
| BT11 × MIR162 × MIR604 | Syngenta Seeds, Inc. | *Bacillus thuringiensis* Cry1Ab delta-endotoxin protein and the genetic material necessary for its production (via elements of vector pZO1502) in Event Bt11 corn (OECD Unique Identifier: SYN-BTO11-1) × *Bacillus thuringiensis* Vip3Aa20 insecticidal protein and the genetic material necessary for its production (via elements of vector pNOV1300) in Event MIR162 maize (OECD Unique Identifier: SYN-IR162-4) × modified Cry3A protein and the genetic material necessary for its production (via elements of vector pZM26) in Event MIR604 corn (OECD Unique Identifier: SYN-1R604-5). |
| CBH-351 | Aventis CropScience | Insect-resistant and glufosinate ammonium herbicide tolerant maize developed by inserting genes encoding Cry9C protein from *Bacillus thuringiensis* subsp *tolworthi* and phosphinothricin acetyltransferase (PAT) from *Streptomyces hygroscopicus*. |
| DAS-06275-8 | DOW AgroSciences LLC | Lepidopteran insect resistant and glufosinate ammonium herbicide-tolerant maize variety produced by inserting the Cry1F gene from *Bacillus thuringiensis* var *aizawai* and the phosphinothricin acetyltransferase (PAT) from *Streptomyces hygroscopicus*. |
| BT11 × MIR604 | Syngenta Seeds, Inc. | Stacked insect resistant and herbicide tolerant maize produced by conventional cross breeding of parental lines BT11 (OECD unique identifier: SYN-BTO11-1) and MIR604 (OECD unique identifier: SYN-1R6O5-5). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm -resistance is derived from MIR604 which contains the mCry3A gene from *Bacillus thuringiensis*. |
| BT11 × MIR604 × GA21 | Syngenta Seeds, Inc. | Stacked insect resistant and herbicide tolerant maize produced by conventional cross breeding of parental lines BT11 (OECD unique identifier: SYN-BTO11-1), MIR604 (OECD unique identifier: SYN-1R6O5-5) and GA21 (OECD unique identifier: MON-OOO21-9). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. Tolerance to glyphosate herbicide is derived from GA21 which contains a a modified EPSPS gene from maize. |
| DAS-59122-7 | DOW AgroSciences LLC and Pioneer Hi-Bred International Inc. | Corn rootworm-resistant maize produced by inserting the Cry34Ab1 and Cry35Ab1 genes from *Bacillus thuringiensis* strain PS149B1. The PAT encoding gene from *Streptomyces viridochromogenes* was introduced as a selectable marker. |
| DAS-59122-7 × TC1507 × NK603 | DOW AgroSciences LLC and Pioneer Hi-Bred International Inc. | Stacked insect resistant and herbicide tolerant maize produced by conventional cross breeding of parental lines DAS-59122-7 (OECD unique identifier: DAS-59122-7) and TC1507 (OECD unique identifier: DAS-O1507-1) with NK603 (OECD unique identifier: MON-OO6O3-6). Corn rootworm-resistance is derived from DAS-59122-7 which contains the Cry34Ab1 and Cry35Ab1 genes from *Bacillus thuringiensis* strain P5149B1. Lepidopteran resistance and tolerance to glufosinate ammonium herbicide is derived from TC1507. Tolerance to glyphosate herbicide is derived from NK603. |

TABLE 4F-continued

| Zea mays L. Maize | | |
|---|---|---|
| Event | Company | Description |
| DBT418 | Dekalb Genetics Corporation | Insect-resistant and glufosinate ammonium herbicide tolerant maize developed by inserting genes encoding Cry1AC protein from *Bacillus thuringiensis* subsp *kurstaki* and phosphinothricin acetyltransferase (PAT) from *Streptomyces hygroscopicus* |
| MIR604 × GA21 | Syngenta Seeds, Inc. | Stacked insect resistant and herbicide tolerant maize produced by conventional cross breeding of parental lines MIR604 (OECD unique identifier: SYN-1R6O5-5) and GA21 (OECD unique identifier: MON-OOO21-9). Corn rootworm-resistance is derived from MIR604 which contains the mCry3A gene from *Bacillus thuringiensis*. Tolerance to glyphosate herbicide is derived from GA21. |
| MON80100 | Monsanto Company | Insect-resistant maize produced by inserting the Cry1Ab gene from *Bacillus thuringiensis* subsp. *kurstaki*. The genetic modification affords resistance to attack by the European corn borer (ECB). |
| MON802 | Monsanto Company | Insect-resistant and glyphosate herbicide tolerant maize produced by inserting the genes encoding the Cry1Ab protein from *Bacillus thuringiensis* and the 5-enolpyruvylshikimate-3-phosphate synthase (EPSPS) from *A. tumefaciens* strain CP4. |
| MON809 | Pioneer Hi-Bred International Inc. | Resistance to European corn borer (*Ostrinia nubilalis*) by introduction of a synthetic Cry1Ab gene. Glyphosate resistance via introduction of the bacterial version of a plant enzyme, 5-enolpyruvyl shikimate-3-phosphate synthase (EPSPS). |
| MON810 | Monsanto Company | Insect-resistant maize produced by inserting a truncated form of the Cry1Ab gene from *Bacillus thuringiensis* subsp. *kurstaki* HD-1. The genetic modification affords resistance to attack by the European corn borer (ECB). |
| MON810 × LY038 | Monsanto Company | Stacked insect resistant and enhanced lysine content maize derived from conventional cross-breeding of the parental lines MON810 (OECD identifier: MON-OO81O-6) and LY038 (OECD identifier: REN-OOO38-3). |
| MON810 × MON88017 | Monsanto Company | Stacked insect resistant and glyphosate tolerant maize derived from conventional cross-breeding of the parental lines MON810 (OECD identifier: MON-OO81O-6) and M0N88017 (OECD identifier: MON-88017-3). European corn borer (ECB) resistance is derived from a truncated form of the Cry1Ab gene from Bacillus thuringiensis subsp. kurstaki HD-1 present in MON810. Corn rootworm resistance is derived from the Cry3Bb1 gene from *Bacillus thuringiensis* subspecies *kumamotoensis* strain EG4691 present in MON88017. Glyphosate tolerance is derived from a 5-enolpyruvylshikimate-3-phosphate synthase (EPSPS) encoding gene from *Agrobacterium tumefaciens* strain CP4 present in MON88017. |
| MON832 | Monsanto Company | Introduction, by particle bombardment, of glyphosate oxidase (GOX) and a modified 5-enolpyruvyl shikimate-3-phosphate synthase (EPSPS), an enzyme involved in the shikimate biochemical pathway for the production of the aromatic amino acids. |
| MON863 | Monsanto Company | Corn rootworm resistant maize produced by inserting the Cry3Bb1 gene from *Bacillus thuringiensis* subsp. *kumamotoensis*. |
| MON863 × MON810 | Monsanto Company | Stacked insect resistant corn hybrid derived from conventional cross-breeding of the parental lines MON863 (OECD identifier: MON-OO863-5) and MON810 (OECD identifier: MON-OO81O-6) |

TABLE 4F-continued

Zea mays L. Maize

| Event | Company | Description |
|---|---|---|
| MON863 × MON810 × NK603 | Monsanto Company | Stacked insect resistant and herbicide tolerant corn hybrid derived from conventional cross-breeding of the stacked hybrid MON-OO863-5 × MON-OO81O-6 and NK603 (OECD identifier: MON-OO6O3-6). |
| MON863 × NK603 | Monsanto Company | Stacked insect resistant and herbicide tolerant corn hybrid derived from conventional cross-breeding of the parental lines MON863 (OECD identifier: MON-OO863-5) and NK603 (OECD identifier: MON-OO6O3-6). |
| MON87460 | Monsanto Company | MON 87460 was developed to provide reduced yield loss under water-limited conditions compared to conventional maize. Efficacy in MON 87460 is derived by expression of the inserted *Bacillus subtilis* cold shock protein B (CspB). |
| MON88017 | Monsanto Company | Corn rootworm-resistant maize produced by inserting the Cry3Bb1 gene from *Bacillus thuringiensis* subspecies *kumamotoensis* strain EG4691. Glyphosate tolerance derived by inserting a 5-enolpyruvylshikimate-3-phosphate synthase (EPSPS) encoding gene from *Agrobacterium tumefaciens* strain CP4. |
| MON89034 | Monsanto Company | Maize event expressing two different insecticidal proteins from *Bacillus thuringiensis* providing resistance to number of Lepidopteran pests. |
| MON89034 × MON88017 | Monsanto Company | Stacked insect resistant and glyphosate tolerant maize derived from conventional cross-breeding of the parental lines MON89034 (OECD identifier: MON-89O34-3) and MON88017 (OECD identifier: MON-88O17-3). Resistance to Lepidopteran insects is derived from two Cry genes present in MON89043. Corn rootworm resistance is derived from a single Cry genes and glyphosate tolerance is derived from the 5-enolpyruvylshikimate-3-phosphate synthase (EPSPS) encoding gene from *Agrobacterium tumefaciens* present in MON88017. |
| MON89034 × NK603 | Monsanto Company | Stacked insect resistant and herbicide tolerant maize produced by conventional cross breeding of parental lines MON89034 (OECD identifier: MON-89034-3) with NK603 (OECD unique identifier: MON-OO6O3-6). Resistance to Lepidopteran insects is derived from two Cry genes present in MON89043. Tolerance to glyphosate herbicide is derived from NK603. |
| NK603 × MON810 | Monsanto Company | Stacked insect resistant and herbicide tolerant corn hybrid derived from conventional cross-breeding of the parental lines NK603 (OECD identifier: MON-OO6O3-6) and MON810 (OECD identifier: MON-OO81O-6). |
| MON89034 × TC1507 × MON88017 × DAS-59122-7 | Monsanto Company and Mycogen Seeds c/o Dow AgroSciences LLC | Stacked insect resistant and herbicide tolerant maize produced by conventional cross breeding of parental lines: MON89034, TC1507, MON88017, and DAS-59122. Resistance to the above-ground and below-ground insect pests and tolerance to glyphosate and glufosinate-ammonium containing herbicides. |
| M53 | Bayer CropScience (Aventis CropScience(AgrEvo)) | Male sterility caused by expression of the barnase ribonuclease gene from *Bacillus amyloliquefaciens*; PPT resistance was via PPT-acetyltransferase (PAT). |
| M56 | Bayer CropScience (Aventis CropScience(AgrEvo)) | Male sterility caused by expression of the barnase ribonuclease gene from *Bacillus amyloliquefaciens*; PPT resistance was via PPT-acetyltransferase (PAT). |
| NK603 | Monsanto Company | Introduction, by particle bombardment, of a modified 5-enolpyruvyl shikimate-3-phosphate synthase (EPSPS), an enzyme involved in the shikim ate biochemical pathway for the production of the aromatic amino acids. |
| NK603 × T25 | Monsanto Company | Stacked glufosinate ammonium and glyphosate herbicide tolerant maize hybrid derived from conventional cross-breeding of the parental lines NK603 (OECD identifier: MON-OO6O3-6) and T25 (OECD identifier: ACS-ZM003-2). |

TABLE 4F-continued

Zea mays L. Maize

| Event | Company | Description |
|---|---|---|
| T25 × MON810 | Bayer CropScience (Aventis CropScience(AgrEvo)) | Stacked insect resistant and herbicide tolerant corn hybrid derived from conventional cross-breeding of the parental lines T25 (OECD identifier: ACS-ZMOO3-2) and MON810 (OECD identifier: MON-OO81O-6). |
| TC1507 | Mycogen (c/o Dow AgroSciences); Pioneer (c/o DuPont) | Insect-resistant and glufosinate ammonium herbicide tolerant maize produced by inserting the Cry1F gene from *Bacillus thuringiensis* var. *aizawai* and the phosphinothricin N-acetyltransferase encoding gene from *Streptomyces viridochromogenes*. |
| TC1507 × NK603 | DOW AgroSciences LLC | Stacked insect resistant and herbicide tolerant corn hybrid derived from conventional cross-breeding of the parental lines 1507 (OECD identifier: DAS-O15O7-1) and NK603 (OECD identifier: MON-OO6O3-6). |
| TC1507 × DAS-59122-7 | DOW AgroSciences LLC and Pioneer Hi-Bred International Inc. | Stacked insect resistant and herbicide tolerant maize produced by conventional cross breeding of parental lines TC1507 (OECD unique identifier: DAS-O15O7-1) with DAS-59122-7 (OECD unique identifier: DAS-59122-7). Resistance to Lepidopteran insects is derived from TC1507 due the presence of the Cry1F gene from *Bacillus thuringiensis* var. *aizawai*. Corn rootworm-resistance is derived from DAS-59122-7 which contains the Cry34Ab1 and Cry35Ab1 genes from *Bacillus thuringiensis* strain P5149B1. Tolerance to glufosinate ammonium herbicide is derived from TC1507 from the phosphinothricin N-acetyltransferase encoding gene from *Streptomyces viridochromogenes*. |

Other events with regulatory approval are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments the stacked trait may be in the form of silencing of one or more polynucleotides of interest resulting in suppression of one or more target pest polypeptides. In some embodiments the silencing is achieved through the use of a suppression DNA construct.

In some embodiments one or more polynucleotide encoding the polypeptides of the PIP-72 polypeptides or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment (U.S. Pat. No. 5,107,065). The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) *Plant J.* 16:651-659 and Gura, (2000) *Nature* 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics: Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) *Nature* 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) *Trends Genet.* 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) *Nature* 409:363). Short interfering RNAs derived from dicer activity are typically about 21 to about 23 nucleotides in length and comprise about 19 base pair duplexes (Elbashir, et al., (2001) *Genes Dev.* 15:188). Dicer has also been implicated in the excision of 21- and 22-nucleotide small temporal RNAs (stRNAs) from precursor RNA of conserved structure that are implicated in translational control (Hutvagner, et al., (2001) *Science* 293: 834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) *Genes Dev.* 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) *Science* 297:1818-1819; Volpe, et al., (2002) *Science* 297: 1833-1837; Jenuwein, (2002) *Science* 297:2215-2218 and Hall, et al., (2002) *Science* 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US Patent Application Publication 2009/0188008.

As used herein, a "suppressor enhancer element" comprises a polynucleotide comprising the target sequence to be suppressed or an active fragment or variant thereof. It is recognize that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in US Patent Application Publication 2011/0301223 and US Patent Application Publication 2009/0192117.

Some embodiments relate to down-regulation of expression of target genes in insect pest species by interfering ribonucleic acid (RNA) molecules. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including in particular Western corn rootworm as a means to control insect infestation. Furthermore, PCT Publication WO 2009/091864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describes potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence. US Patent Application Publication 2009/0192117 describes suppression of target polynucleotides from *Lygus*.

Use in Pesticidal Control

General methods for employing strains comprising a nucleic acid sequence of the embodiments or a variant thereof, in pesticide control or in engineering other organisms as pesticidal agents are known in the art. See, for example U.S. Pat. No. 5,039,523 and EP 0480762A2.

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the PIP-72 polypeptide, and desirably, provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*, fungi, particularly yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Pseudomonas chlororaphis, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinelandii* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae*, and *Aureobasidium pollulans*. Of particular interest are the pigmented microorganisms. Host organisms of particular interest include yeast, such as *Rhodotorula* spp., *Aureobasidium* spp., *Saccharomyces* spp. (such as *S. cerevisiae*), *Sporobolomyces* spp., phylloplane organisms such as *Pseudomonas* spp. (such as *P. aeruginosa, P. fluorescens, P. chlororaphis*), *Erwinia* spp., and *Flavobacterium* spp., and other such organisms, including *Agrobacterium tumefaciens, E. coli, Bacillus subtilis, Bacillus cereus* and the like.

Genes encoding the PIP-72 polypeptides of the embodiments can be introduced into microorganisms that multiply on plants (epiphytes) to deliver PIP-72 polypeptides to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman et al. (1991) *Appl. Environ. Microbiol.* 56:713-718). Genes encoding the PIP-72 polypeptides of the embodiments can be introduced into a root-colonizing *Bacillus cereus* by standard methods known in the art.

Genes encoding PIP-72 polypeptides can be introduced, for example, into the root-colonizing *Bacillus* by means of electro transformation. Specifically, genes encoding the PIP-72 polypeptides can be cloned into a shuttle vector, for example, pHT3101 (Lerecius, et al., (1989) *FEMS Microbiol. Letts.* 60:211-218. The shuttle vector pHT3101 containing the coding sequence for the particular PIP-72 polypeptide gene can, for example, be transformed into the root-colonizing *Bacillus* by means of electroporation (Lerecius, et al., (1989) *FEMS Microbiol. Letts.* 60:211-218).

Expression systems can be designed so that PIP-72 polypeptides are secreted outside the cytoplasm of gram-negative bacteria, such as *E. coli*, for example. Advantages of having PIP-72 polypeptides secreted are: (1) avoidance of potential cytotoxic effects of the PIP-72 polypeptide expressed; and (2) improvement in the efficiency of purification of the PIP-72 polypeptide, including, but not limited to, increased efficiency in the recovery and purification of the protein per volume cell broth and decreased time and/or costs of recovery and purification per unit protein.

PIP-72 polypeptides can be made to be secreted in *E. coli*, for example, by fusing an appropriate *E. coli* signal peptide to the amino-terminal end of the PIP-72 polypeptide. Signal peptides recognized by *E. coli* can be found in proteins already known to be secreted in *E. coli*, for example the OmpA protein (Ghrayeb, et al., (1984) *EMBO J*, 3:2437-2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud, et al., (1987) *Meth. Enzymol.* 153: 492).

PIP-72 polypeptides of the embodiments can be fermented in a bacterial host and the resulting bacteria processed and used as a microbial spray in the same manner that Bt strains have been used as insecticidal sprays. In the case of a PIP-72 polypeptide(s) that is secreted from *Bacillus*, the secretion signal is removed or mutated using procedures known in the art. Such mutations and/or deletions prevent secretion of the PIP-72 polypeptide(s) into the growth medium during the fermentation process. The PIP-72 polypeptides are retained within the cell, and the cells are then processed to yield the encapsulated PIP-72 polypeptides. Any suitable microorganism can be used for this purpose. *Pseudomonas* has been used to express Bt toxins as encapsulated proteins and the resulting cells processed and sprayed as an insecticide (Gaertner, et al., (1993), in: *Advanced Engineered Pesticides*, ed. Kim).

Alternatively, the PIP-72 polypeptides are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated PIP-72 polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient or an agrochemical composition that contains at least one of the PIP-72 polypeptides produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides.

Exemplary chemical compositions include: Fruits/Veqetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Veqetables Insecticides: Aldicarb, *Bacillus* thuriengiensis, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, loxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, lodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S-) Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Funaicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2(5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2(5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments the insecticide is Esfenvalerate, Chlorantraniliprole, Methomyl, Indoxacarb, Oxamyl or combinations thereof.

In some embodiment the herbicide is a homogentisate solanesyltransferase (HST) inhibiting herbicide and/or hydroxyphenyl pyruvate dioxygenase (HPPD) inhibiting herbicide of US Patent Publication US2011173718.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* J E Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira (Xylomyges) curialis* Grote (*citrus* cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rösslerstamm (summer fruit *tortrix* moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermüller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Tussah Moth); *Bombyx mori* Linnaeus (Silkworm); *Bucculatrix thurberiella* Busck (cotton leaf perforator); *Colias eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (*citrus* leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenée; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape *colaspis*); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (*sorghum* midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other Nematocera.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, *phylloxera* from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black *citrus* aphid) and *T. citricida* Kirkaldy (brown *citrus* aphid); *Melanaphis sacchari* (sugarcane aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); *Dialeurodes citri* Ashmead (*citrus* whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cincticeps* Uhler (green leafhopper); *N. nigropictus* Stal (rice leafhopper); *Nilaparvata lugens* Stal (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (*citrus* mealybug); *Pseudococcus* spp. (other mealybug complex); *Cacopsylla pyricola* Foerster (pear psylla); *Trioza diospyri* Ashmead (persimmon *psylla*).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schäffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); Spanagonicus albofasciatus Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp. and *Cimicidae* spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (*citrus* flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus,* and *Bagrada hilaris* (*Bagrada* Bug)), the family Plataspidae (*Megacopta cribraria*—Bean plataspid) and the family Cydnidae (*Scaptocoris castanea*—

Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743,477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C.D.S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), *bradyrhizobium* spp. (including one or more of *betae, canariense, elkanii, iriomotense, japonicum, liaonigense, pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, *penicillium*, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, *trichoderma*, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest with an insecticidally-effective amount of a recombinant PIP-72 polypeptide. In some embodiments methods are provided for killing an insect pest, comprising contacting the insect pest with an insecticidally-effective amount of a recombinant pesticidal protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772 or SEQ ID NO: 852 or a variant thereof.

In some embodiments methods are provided for controlling an insect pest population, comprising contacting the insect pest population with an insecticidally-effective amount of a recombinant PIP-72 polypeptide. In some embodiments methods are provided for controlling an insect pest population, comprising contacting the insect pest population with an insecticidally-effective amount of a recombinant pesticidal protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772 or SEQ ID NO: 852 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population with an insecticidally-effective amount of a recombinant PIP-72 polypeptide. In some embodiments methods are provided for controlling an insect pest population resistant to a pesticidal protein, comprising contacting the insect pest population with an insecticidally-effective amount of a recombinant pesticidal protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772 or SEQ ID NO: 852 or a variant thereof.

In some embodiments methods are provided for protecting a plant from an insect pest, comprising expressing in the plant or cell thereof a recombinant polynucleotide encoding a PIP-72 polypeptide. In some embodiments methods are provided for protecting a plant from an insect pest, comprising expressing in the plant or cell thereof a recombinant polynucleotide encoding pesticidal protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772 or SEQ ID NO: 852 or variants thereof.

In some embodiments methods are provided for killing an insect pest, comprising contacting the insect pest with an insecticidally-effective amount of a recombinant polypeptide of SEQ ID NO: 20, SEQ ID NO: 22, SEQ ID NO: 24, SEQ I NO: 26, SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948 or a variant thereof.

In some embodiments methods are provided for controlling an insect pest population, comprising contacting the insect pest population with an effective amount of a recombinant polypeptide of SEQ ID NO: 20, SEQ ID NO: 22, SEQ ID NO: 24, SEQ I NO: 26, SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population with an effective amount of a recombinant polypeptide of SEQ ID NO: 20, SEQ ID NO: 22, SEQ ID NO: 24, SEQ I NO: 26, SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948 or a variant thereof.

In some embodiments methods are provided for protecting a plant from an insect pest, comprising expressing in the plant or cell thereof a recombinant polynucleotide encoding a pesticidal protein of SEQ ID NO: 20, SEQ ID NO: 22, SEQ ID NO: 24, SEQ I NO: 26, SEQ ID NO: 30, SEQ ID NO: 34, SEQ ID NO: 36, SEQ ID NO: 929, SEQ ID NO: 930, SEQ ID NO: 931, SEQ ID NO: 937, SEQ ID NO: 938, SEQ ID NO: 942, SEQ ID NO: 947, or SEQ ID NO: 948 or variants thereof.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the PIP-72 polypeptides of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management the at least one of the insecticidal proteins comprise a PIP-72 polypeptide insecticidal to insects in the order Lepidoptera and/or Coleoptera.

In some embodiments the methods of controlling Lepidoptera and/or Coleoptera insect infestation in a transgenic plant and promoting insect resistance management the at least one of the insecticidal proteins comprises a protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945, or SEQ ID NO: 946 or variants thereof, insecticidal to insects in the order Lepidoptera and/or Coleoptera.

In some embodiments the methods of controlling Lepidoptera and/or Coleoptera insect infestation in a transgenic plant and promoting insect resistance management comprise expressing in the transgenic plant a PIP-72 polypeptide and a Cry protein insecticidal to insects in the order Lepidoptera and/or Coleoptera having different modes of action.

In some embodiments the methods of controlling Lepidoptera and/or Coleoptera insect infestation in a transgenic plant and promoting insect resistance management comprise in the transgenic plant a protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945, or SEQ ID NO: 946 or variants thereof and a Cry protein insecticidal to insects in the order Lepidoptera and/or Coleoptera having different modes of action.

Also provided are methods of reducing likelihood of emergence of Lepidoptera and/or Coleoptera insect resistance to transgenic plants expressing in the plants insecticidal proteins to control the insect species, comprising expression of a PIP-72 polypeptide insecticidal to the insect species in combination with a second insecticidal protein to the insect species having different modes of action.

Also provided are methods of reducing likelihood of emergence of Lepidoptera and/or Coleoptera insect resistance to transgenic plants expressing in the plants insecticidal proteins to control the insect species, comprising expression of a protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945, or SEQ ID NO: 946 or variants thereof, insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a PIP-72 polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772, SEQ ID NO: 852, any one of SEQ ID NO: 903-SEQ ID NO: 914, SEQ ID NO: 927, SEQ ID NO: 928, SEQ ID NO: 932, SEQ ID NO: 933, SEQ ID NO: 934, SEQ ID NO: 935, SEQ ID NO: 936, SEQ ID NO: 939, SEQ ID NO: 940, SEQ ID NO: 941, SEQ ID NO: 943, SEQ ID NO: 944, SEQ ID NO: 945, or SEQ ID NO: 946 or variants thereof and a Cry protein.

In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the PIP-72 polypeptide does not compete with binding sites for Cry proteins in such insects. In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 18, SEQ ID NO: 28, SEQ ID NO: 32, any one of SEQ ID NO: 528-SEQ ID NO: 768, any one of SEQ ID NO: 825-SEQ ID NO: 844, SEQ ID NO: 771, SEQ ID NO: 772 or SEQ ID NO: 852 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing a PIP-72 polypeptide disclosed herein. Expression of the PIP-72 polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising a PIP-72 polypeptide. The plants, plant parts or seeds provided herein, can be processed to yield oil, protein products and/or by-products that are derivatives obtained by processing that have commercial value. Non-limiting examples include transgenic seeds comprising a nucleic acid molecule encoding a PIP-72 polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXPERIMENTALS

Example 1—Identification of a Insecticidal Protein Active Against Western Corn Root Worm (WCRW) from Strain SS143D5

The WCRW (*Diabrotica virgifera virgifera*) active protein PIP-72Aa was identified by protein purification, liquid chromatography mass spectrometry (LC-MS/MS) and PCR cloning from *Pseudomonas chlororaphis* strain SS143D5 as follows:

Insecticidal activity against WCRW (*Diabrotica virgifera virgifera*) was observed from a clear cell lysate of SS143D5 grown in Trypticase soy medium (Tryptone 17 g/L, enzymatic digest of soy meal 3 g/L, Dextrose 2.5 g/L, Sodium Chloride 5 g/L, K2HPO4 2.5 g/L) and cultured overnight at 2600 with shaking at 250 rpm. This insecticidal activity exhibited heat and proteinase sensitivity indicating proteinaceous nature. For protein extraction, cells were thawed and re-suspended in 50 mM sodium acetate buffer, pH 5 (buffer A) containing protease inhibitor cocktail V from CalBiochem. A crude cleared lysate was obtained by passing the cells through a homogenizer at 30,000 psi, followed by centrifugation at 13,800×g for 20 min.

WCRW bioassays were conducted using 10 microliter cell lysate samples mixed with molten low-melt WCRW diet (Southland Products Inc., Lake Village, Ark.) in a 96 well format. *Diabrotica virgifera virgifera* neonates were placed into each well of a 96 well plate. The assay was run for 4 days at 25° C. and then was scored for insect mortality and stunting of insect growth. The scores were noted as dead, severely stunted (little or no growth but alive), stunted (growth to second instar but not equivalent to controls) or no activity.

Genomic DNA from strain SS143D5 was extracted with a Sigma-Aldrich® Bacterial Genomic DNA Extraction Kit (Cat # NA2110-KT, Sigma-Aldrich, PO Box 14508, St. Louis, Mo. 63178) according to the manufactures' instructions. The DNA concentration was determined using a NanoDrop® Spectrophotometer (Thermo Fisher Scientific®, 3411 Silverside Road, Bancroft Building, Suite 100, Willmington, Del. 19810) and the genomic DNA was diluted to 40 ng/ul with sterile water. A 25 ul PCR reaction was set up by combining 80 ng genomic DNA, 2 ul (5 uM) 16S ribosomal DNA primers TACCTTGTTACGACTT (SEQ ID NO: 285) and AGAGTTTGATCMTGGCTCAG (SEQ ID NO: 286), 1 ul 10 cmM dNTP, 1× Phusion® HF™ buffer, and 1 unit of Phusion® High-Fidelity DNA Polymerase (New England Biolabs®, Cat #M0530L, 240 County Road, Ipswich, Mass. 01938-2723). The PCR reaction was run in a MJ Research PTC-200 Thermo Cycler (Bio-Rad® Laboratories, Inc., 1000 Alfred Nobel Drive, Hercules, Calif., 94547, USA) with the following program: 96° C. 1 min; 30 cycles of 96° C. 15 seconds, 52° C. 2 minutes and 72° C. 2 minutes; 72° C. 10 minutes; and hold on 4° C. The PCR products were purified with QiaQuick® DNA purification Kit (Cat #28104, QIAGEN® Inc., 27220 Turnberry Lane, Valencia, Calif. 91355). The purified PCR sample was DNA sequenced and the resulting 16S ribosomal DNA sequence was BLAST searched against the NCBI database which indicated that SS143D5 is a *Pseudomonas chlororaphis* strain. The *Pseudomonas chlororaphis* strain SS143D5 was deposited on Feb. 7, 2013 under accession # NRRL B-50810 with the Agricultural Research Service Culture Collection (NRRL), 1815 North University Street, Peoria, Ill. 61604, (nrrl.ncaur.usda.gov, which can be accessed on the worldwide web using the "www" prefix).

Isolated strain SS143D5 genomic DNA was also prepared according to a library construction protocol developed by Illumina and sequenced using the Illumina® Genome Analyzer® IIx (Cat# SY-301-1301, Illumina Inc., 9885 Towne Center Drive, San Diego, Calif. 92121). The nucleic acid contig sequences were assembled and open reading frames were generated.

Cell pellet of an overnight culture of SS143D5 grown in 2×YT broth at 26° C. with shaking at 250 rpm was lyzed at ~20,000 psi after resuspension in acetate buffer, pH 5. The crude lysate was cleared by centrifugation and loaded onto a HiTrap™ S-HP column (GE Healthcare, 800 Centennial Avenue, P.O. Box 1327, Piscataway, N.J. 08855). Bound protein was eluted with a linear sodium chloride gradient and fractionated. Fractions containing protein of interest were pooled and buffer exchanged for loading onto a MonoQ™ column (GE Healthcare), run at pH 8. PIP-72Aa (SEQ ID NO: 2) was eluted with a linear sodium chloride gradient and after activity confirmation further purified by hydrophobic interaction chromatography. For this the protein was adjusted to 0.8 M ammonium sulfate, loaded onto a HiTrap™ Butyl-HP column (GE Healthcare) and active protein was recovered in the unbound fraction. SDS-PAGE analysis showed a single band after staining with Coomassie™ Blue dye. The protein band was excised, digested with trypsin and analyzed by nano-liquid chromatography/electrospray tandem mass spectrometry (nano-LC/ESI-MS/MS) on a Thermo Q Exactive™ Orbitrap™ mass spectrometer (Thermo Fisher Scientific®, 81 Wyman Street, Waltham, Mass. 02454) interfaced with an Eksigent NanoLC 1-D Plus nano-lc system (AB Sciex™, 500 Old Connecticut Path, Framingham, Mass. 01701, USA). Ten product ion spectra were collected in an information dependent acquisition mode after a MS1 survey scan.

Protein identification was done by database searches using Mascot® (Matrix Science, 10 Perrins Lane, London NW3 1QY, UK). The search against the in-house database Bacteria-Plus, which combines all bacterial protein sequences and keratin sequences derived from the NCBI non-redundant database (nr) as well as in-house protein sequences, identified a novel gene encoded by strain SS143D5, which was designated as PIP-72Aa (SEQ ID NO: 1).

Example 2—Identification of Homologs of PIP-72Aa

Gene identities may be determined by conducting BLAST (Basic Local Alignment Search Tool; Altschul, et al., (1993) *J. Mol. Biol.* 215:403-410; see also ncbi.nlm.nih.gov/BLAST/, which can be accessed using the www prefix) searches under default parameters for similarity to sequences contained in the publically available BLAST "nr" database (comprising all non-redundant GenBank CDS translations, sequences derived from the 3-dimensional structure Brookhaven Protein Data Bank, the last major release of the 25 SWISS-PROT protein sequence database, EMBL, and DDBJ databases. In addition to public databases, internal DuPont Pioneer databases were searched. The polynucleotide sequences SEQ ID NO: 1 was analyzed.

The search identified several homologs of PIP-72Aa (SEQ ID NO: 2) having varying percent identity to PIP-72Aa (SEQ ID NO: 2). Insecticidal active PIP-72Aa homologs designated herein as: PIP-72Ba (SEQ ID NO: 4); PIP-72Ca (SEQ ID NO: 6); PIP-72Cb (SEQ ID NO: 8); PIP-72 Da (SEQ ID NO: 10); PIP-72Db (SEQ ID NO: 12); PIP-72Dc (SEQ ID NO: 14); PIP-72Fa (SEQ ID NO: 18); PIP-72Ff (SEQ ID NO: 28) and PIP-72Gb (SEQ ID NO: 32) were identified from a DuPont Pioneer internal bacterial genome database from: *Pseudomonas rhodesiae*; *Pseudomonas chlororaphis*; *Pseudomonas mandelii*; *Pseudomonas congelans*; *Pseudomonas mandelii*; *Pseudomonas ficuserectae*; *Pseudomonas mosselii*; *Pseudomonas chlororaphis*; and *Pseudomonas chlororaphis* respectively. PIP-72Ba (SEQ ID NO: 4); PIP-72Ca (SEQ ID NO: 6); PIP-72Cb (SEQ ID NO: 8); PIP-72 Da (SEQ ID NO: 10); PIP-72Db (SEQ ID NO: 12); PIP-72Dc (SEQ ID NO: 14); PIP-72Fa (SEQ ID NO: 18); PIP-72Ff (SEQ ID NO: 28) and PIP-72Gb (SEQ ID NO: 32) are encoded by SEQ ID NO: 3; SEQ ID NO: 5; SEQ ID NO: 7; SEQ ID NO: 9; SEQ ID NO: 11; SEQ ID NO: 13; SEQ ID NO: 17; SEQ ID NO: 27 and SEQ ID NO: 31, respectively. The inactive low identity homologs designated herein as PIP-72Ea (SEQ ID NO: 16) and PIP-72Ge (SEQ ID NO: 38) were identified from a DuPont Pioneer internal bacterial genome database from *Pseudomonas congelans* and *Pseudomonas chlororaphis* respectively. PIP-72Ea and PIP-72Ge are encoded by SEQ ID NO: 15 and SEQ ID NO: 37, respectively.

The more distant insecticidal active homologs designated herein as: GBP_A3175 (SEQ ID NO: 20—Hypothetical Protein GBP346_A3175, Accession # YP_002897852); JG43047 (SEQ ID NO: 24—Hypothetical Protein, Accession # JGI-2165143047) and PFL_6283 (SEQ ID NO: 30—Hypothetical Protein, Accession # YP_004842361.1) were identified from external public databases from: *Burkholderia pseudomallei* MSHR346; *Pseudomonas* sp. and *Pseudomonas protegens* Pf-5, respectively. GBP_A3175 (SEQ ID NO: 20); JG43047 (SEQ ID NO: 24) and PFL_6283 (SEQ ID NO: 30) are encoded by SEQ ID NO: 19, SEQ ID NO: 23 and SEQ ID NO: 29, respectively.

The more distant homologs, which were not expressed or were inactive at the concentrations tested were designated as SRBS_294080 (SEQ ID NO: 22—Hypothetical Protein from a Switchgrass rhizospere MC, Accession # JGI 2021745495); SwiRh_4910 (SEQ ID NO: 26—Hypothetical Protein from Switchgrass rhizosphere, Accession # JGI-SwiRh_1014910); XBJ1_1078 (SEQ ID NO: 34—Hypothetical Protein XBJ1_1078 from *Xenorhabdus* bovienii SS-2004, Accession # YP_003467009) and plu2373 (SEQ ID NO: 36—Hypothetical Protein plu2373 from *Photorhabdus luminescens* subsp. *laumondii* TTO1, Accession # NP_929618) were identified from external public databases; *Xenorhabdus* encoded by SEQ ID NO: 21; SEQ ID NO: 25; SEQ ID NO: 33 and SEQ ID NO: 35, respectively.

Additional PIP-72 homologs were identified from BLAST searching public databases and internal DuPont Pioneer databases basically as described above. Table 5 shows the PIP-72 polypeptide designation, percent idientiy to IPDO72Aa (SEQ ID NO: 2), source of the bacterial strain, and bacterial species. Table 6 shows the PIP-72 polypeptide designation, polypeptide sequence identifier, and polynucleotide sequence identifier.

TABLE 5

| PIP-72 homolog | Identity to PIP-72Aa SEQ ID NO: 2 | Source | Species |
| --- | --- | --- | --- |
| PIP-72Ab | 94.2% | internal active strain—SSP587D6-1 | *Pseudomonas chlororaphis* |
| PIP-72Bb | 87.4% | internal collection—SSP555A5b; JH54973-1 | *Pseudomonas brassicacearum* |
| WP_030131237 | 77.9% | NCBI-WP_030131237—hypothetical protein | *Pseudomonas* sp. QTF5 |
| WP_016417435 | 50.6% | NCBI-hypothetical protein WP_016417435.1 | *Halomonas anticariensis* |
| BDL_2850 | 41.1% | NCBI hypothetical protein BDL_2850 (AHE26696) | *Burkholderia pseudomallei* |
| PIP-72Fh | 41.9% | internal active strain SSP533D8d; SS143C5; SSP436A3a; SSP535F2a; SSP429C9a | *Pseudomonas entomophila* L48 |
| PIP-72Fi | 41.9% | internal active strain SSP533G1a | *Pseudomonas entomophila* |
| PIP-72Fj | 39.5% | internal active strain JH44835-2; JH59153-1 | *Pseudomonas chlororaphis* |
| PIP-72Fk | 41.9% | internal active strain JH52442-1; JH52448-2 | *Pseudomonas chlororaphis* |
| PIP-72Fl | 44.9% | internal active strain JH59178-1; JH59094-1 | *Burkholderia multivorans* |
| BBK_2354 | 43.0% | NCBI hypothetical protein WP_023360071.1 BBK_2354 | *Burkholderia pseudomallei* |
| D512_15386 | 38.6% | NCBI hypothetical protein D512_15386 ZP_23811189.1 | *Burkholderia pseudomallei* MSHR1043 |
| PIP-72Gg | 33% | internal collection—SSP459B9-3; SSP541A11-3; SSP560B2a; SSP560B12c | *Pseudomonas chlororaphis* |
| PIP-72Gh | 38.4% | internal collection—SSP469F1d | *Pseudomonas chlororaphis* |
| PIP-72Gi | 39.5% | internal collection—SSP471D1a; SSP471D1c; SSP4G8; SSP514E4-3; SSP514E2-1; | *Pseudomonas mosselli* |
| BTI_1023 | 37.5% | hypothetical protein BTI_1023, YP_007917531; EMBL-N0ALH1_BURTH | *Burkholderia thallandensis* |
| PIP-72Gk | 37.5% | internal collection—JH34931-1 | *Pseudomonas protegens* |
| PIP-72Gl | 39.5% | internal collection—SSP490B11a; SSP514E2-1; SSP341E4-3 | *Pseudomonas plecoglossicida* |
| PIP-72Gm | 37.8% | internal collection—JH23445-2 | |
| PIP-72Gn | 38.4% | internal collection—SSP579D5-2, SSP581D7-1; SSP579D8-1 | *Pseudomonas chlororaphis* |

TABLE 5-continued

| PIP-72 homolog | Identity to PIP-72Aa SEQ ID NO: 2 | Source | Species |
|---|---|---|---|
| WP_028536646 | 39.5% | NCBI-WP_028536646.1—hypothetical protein | *Paludibacterium yongneupense* |
| BTRA_1468 | 38.9% | NCBI-AIC88674.1—hypothetical protein BTRA_1468 | *Burkholderia thallandensis* |

TABLE 6

| PIP-72 homolog | Polypeptide | Polynucleotide |
|---|---|---|
| PIP-72Ab | SEQ ID NO: 927 | SEQ ID NO: 949 |
| PIP-72Bb | SEQ ID NO: 928 | SEQ ID NO: 950 |
| WP_030131237 | SEQ ID NO: 929 | SEQ ID NO: 951 |
| WP_016417435 | SEQ ID NO: 930 | SEQ ID NO: 952 |
| BDL_2850 | SEQ ID NO: 931 | SEQ ID NO: 953 |
| PIP-72Fh | SEQ ID NO: 932 | SEQ ID NO: 954 |
| PIP-72Fi | SEQ ID NO: 933 | SEQ ID NO: 955 |
| PIP-72Fj | SEQ ID NO: 934 | SEQ ID NO: 956 |
| PIP-72Fk | SEQ ID NO: 935 | SEQ ID NO: 957 |
| PIP-72Fl | SEQ ID NO: 936 | SEQ ID NO: 958 |
| BBK_2354 | SEQ ID NO: 937 | SEQ ID NO: 959 |
| D512_15386 | SEQ ID NO: 938 | SEQ ID NO: 960 |
| PIP-72Gg | SEQ ID NO: 939 | SEQ ID NO: 961 |
| PIP-72Gh | SEQ ID NO: 940 | SEQ ID NO: 962 |
| PIP-72Gi | SEQ ID NO: 941 | SEQ ID NO: 963 |
| BTI_1023 | SEQ ID NO: 942 | SEQ ID NO: 964 |
| PIP-72Gk | SEQ ID NO: 943 | SEQ ID NO: 965 |
| PIP-72Gl | SEQ ID NO: 944 | SEQ ID NO: 966 |
| PIP-72Gm | SEQ ID NO: 945 | SEQ ID NO: 967 |
| PIP-72Gn | SEQ ID NO: 946 | SEQ ID NO: 968 |
| WP_028536646 | SEQ ID NO: 947 | SEQ ID NO: 969 |
| BTRA_1468 | SEQ ID NO: 948 | SEQ ID NO: 970 |

FIG. 1 shows the amino acid sequence alignment of PIP-72Aa (SEQ ID NO: 2), PIP-72Ba (SEQ ID NO: 4); PIP-72Ca (SEQ ID NO: 6); PIP-72Cb (SEQ ID NO: 8); PIP-72 Da (SEQ ID NO: 10); PIP-72Db (SEQ ID NO: 12); PIP-72Dc (SEQ ID NO: 14); PIP-72Ea (SEQ ID NO: 16), PIP-72Fa (SEQ ID NO: 18); GBP_A3175 (SEQ ID NO: 20), SRBS_294080 (SEQ ID NO: 22); JG43047 (SEQ ID NO: 24); SwiRh_4910 (SEQ ID NO: 26); PIP-72Ff (SEQ ID NO: 28), PFL_6283 (SEQ ID NO: 30); PIP-72Gb (SEQ ID NO: 32); XBJ1_1078 (SEQ ID NO: 34); plu2373 (SEQ ID NO: 36); and PIP-72Ge (SEQ ID NO: 38). The amino acid sequence diversity is highlighted. Amino acids 37-51 (Motif 1) relative to PIP-72Aa (SEQ ID NO: 2) are underlined.

FIG. 2 shows an alignment of the amino acid sequences of PIP-72Aa (SEQ ID NO: 2), PIP-72Ab (SEQ ID NO: 927); PIP-72Ba (SEQ ID NO: 4); PIP-72Bb (SEQ ID NO: 928); PIP-72Ca (SEQ ID NO: 6); PIP-72Cb (SEQ ID NO: 8); WP_030131237 (SEQ ID NO: 929); PIP-72 Da (SEQ ID NO: 10); PIP-72Db (SEQ ID NO: 12); PIP-72Dc (SEQ ID NO: 14); PIP-72Fa (SEQ ID NO: 18); and GBP_A3175 (SEQ ID NO: 20). The amino acid sequence diversity between PIP-72Aa (SEQ ID NO: 2) and the other homologs is indicated with shading.

FIG. 3 shows the amino acid sequence alignment of PIP-72Aa (SEQ ID NO: 2), PIP-72Ba (SEQ ID NO: 4); PIP-72Ca (SEQ ID NO: 6); PIP-72Cb (SEQ ID NO: 8); PIP-72 Da (SEQ ID NO: 10); PIP-72Db (SEQ ID NO: 12); and PIP-72Dc (SEQ ID NO: 14). The amino acid sequence diversity between PIP-72Aa (SEQ ID NO: 2) and the other homologs is indicated with shading.

FIG. 4 shows the amino acid sequence alignment of WP_030131237 (SEQ ID NO: 929) PIP-72Ca (SEQ ID NO: 6); PIP-72Cb (SEQ ID NO: 8); PIP-72 Da (SEQ ID NO: 10); PIP-72Db (SEQ ID NO: 12); and PIP-72Dc (SEQ ID NO: 14). The amino acid sequence diversity between PIP-72Da (SEQ ID NO: 10) and the other homologs is indicated with shading.

FIG. 5 shows an alignment of the amino acid sequences of PIP-72Fh (SEQ ID NO: 932), PIP-72Gi (SEQ ID NO: 941); PIP-72Fi (SEQ ID NO: 933); PIP-72Gl (SEQ ID NO: 944); PIP-72Fa (SEQ ID NO: 14). The amino acid diversity between PIP-72Ca (SEQ ID NO: 2) and the other homologs is indicated with shading.

Table 7 shows the sequence identity between the PIP-72 homologs.

TABLE 7

| | GBP_A3175 SEQ ID NO: 20 | PIP-72Ab SEQ ID NO: 927 | PIP-72Bb SEQ ID NO: 928 | WP_030131237 SEQ ID NO: 929 | WP_016417435 SEQ ID NO: 930 | BDL_2850 SEQ ID NO: 931 | PIP-72Fh SEQ ID NO: 932 | PIP-72Fi SEQ ID NO: 933 |
|---|---|---|---|---|---|---|---|---|
| PIP-72Aa (SEQ ID NO: 2) | 42.2 | 94.2 | 88.4 | 77.9 | 51.2 | 41.1 | 39.6 | 39.6 |
| GBP_A3175 | — | 43.3 | 46.7 | 46.7 | 47.8 | 97.8 | 34.4 | 38.7 |
| PIP-72Ab | — | — | 87.2 | 75.6 | 48.8 | 42.2 | 39.6 | 39.6 |
| PIP-72Bb | — | — | — | 80.2 | 48.8 | 45.6 | 40.7 | 40.7 |
| WP_030131237 | — | — | — | — | 52.3 | 45.6 | 37.4 | 37.4 |
| WP_016417435 | — | — | — | — | — | 46.7 | 33.0 | 33.0 |
| BDL_2850 | — | — | — | — | — | — | 33.3 | 37.6 |
| PIP-72Fh | — | — | — | — | — | — | — | 93.4 |
| PIP-72Fi | — | — | — | — | — | — | — | — |
| PIP-72Fj | — | — | — | — | — | — | — | — |
| PIP-72Fk | — | — | — | — | — | — | — | — |
| PIP-72Fl | — | — | — | — | — | — | — | — |
| BBK_2354 | — | — | — | — | — | — | — | — |
| D512_15386 | — | — | — | — | — | — | — | — |
| PIP-72Gg | — | — | — | — | — | — | — | — |
| PIP-72Gh | — | — | — | — | — | — | — | — |
| PIP-72Gi | — | — | — | — | — | — | — | — |
| BTI_1023 | — | — | — | — | — | — | — | — |
| PIP-72Gk | — | — | — | — | — | — | — | — |
| PIP-72Gl | — | — | — | — | — | — | — | — |
| PIP-72Gm | — | — | — | — | — | — | — | — |
| PIP-72Gn | — | — | — | — | — | — | — | — |
| WP_028536646 | — | — | — | — | — | — | — | — |
| BTRA_1468 | — | — | — | — | — | — | — | — |

TABLE 7-continued

| | | | | | | | | |
|---|---|---|---|---|---|---|---|---|
| JG43047 | — | — | — | — | — | — | — | — |
| PFL_6283 | — | — | — | — | — | — | — | — |
| PIP-72Ba | — | — | — | — | — | — | — | — |
| PIP-72Ca | — | — | — | — | — | — | — | — |
| PIP-72Cb | — | — | — | — | — | — | — | — |
| PIP-72Da | — | — | — | — | — | — | — | — |
| PIP-72Db | — | — | — | — | — | — | — | — |
| PIP-72Dc | — | — | — | — | — | — | — | — |
| PIP-72Ea | — | — | — | — | — | — | — | — |
| PIP-72Fa | — | — | — | — | — | — | — | — |
| PIP-72Ff | — | — | — | — | — | — | — | — |
| PIP-72Gb | — | — | — | — | — | — | — | — |
| PIP-72Ge | — | — | — | — | — | — | — | — |
| Plu2373 | — | — | — | — | — | — | — | — |
| SRBS_294080 | — | — | — | — | — | — | — | — |
| SwiRh_4910 | — | — | — | — | — | — | — | — |
| XBJ1_1078 | — | — | — | — | — | — | — | — |

| | PIP-72Fj SEQ ID NO: 934 | PIP-72Fk SEQ ID NO: 935 | PIP-72Fl SEQ ID NO: 936 | BBK_2354 SEQ ID NO: 937 | D512_15386 SEQ ID NO: 938 | PIP-72Gg SEQ ID NO: 939 | PIP-72Gh SEQ ID NO: 940 | PIP-72Gi SEQ ID NO: 941 |
|---|---|---|---|---|---|---|---|---|
| PIP-72Aa (SEQ ID NO: 2) | 35.4 | 37.5 | 44.9 | 41.1 | 37.0 | 33.7 | 34.4 | 37.4 |
| GBP_A3175 | 38.1 | 41.2 | 42.9 | 98.9 | 89.1 | 34.7 | 38.1 | 37.6 |
| PIP-72Ab | 33.3 | 35.4 | 46.1 | 42.2 | 38.0 | 31.6 | 32.3 | 37.4 |
| PIP-72Bb | 31.2 | 33.3 | 43.8 | 45.6 | 41.3 | 33.7 | 30.2 | 38.5 |
| WP_030131237 | 34.4 | 35.4 | 47.2 | 45.6 | 42.4 | 31.6 | 33.3 | 35.2 |
| WP_016417435 | 35.4 | 37.4 | 36.0 | 46.7 | 42.4 | 35.8 | 34.3 | 33.0 |
| BDL_2850 | 38.1 | 41.2 | 41.8 | 98.9 | 91.3 | 33.7 | 38.1 | 36.6 |
| PIP-72Fh | 52.1 | 55.2 | 28.3 | 33.3 | 32.6 | 43.4 | 52.1 | 94.5 |
| PIP-72Fi | 53.1 | 56.2 | 27.2 | 37.6 | 36.8 | 41.7 | 53.1 | 94.5 |
| PIP-72Fj | — | 80.2 | 34.0 | 38.1 | 38.4 | 48.5 | 92.7 | 55.2 |
| PIP-72Fk | — | — | 32.0 | 41.2 | 39.4 | 42.6 | 80.2 | 58.3 |
| PIP-72Fl | — | — | — | 41.8 | 37.6 | 35.4 | 36.1 | 29.3 |
| BBK_2354 | — | — | — | — | 90.2 | 34.7 | 38.1 | 36.6 |
| D512_15386 | — | — | — | — | — | 33.7 | 38.4 | 35.8 |
| PIP-72Gg | — | — | — | — | — | — | 50.5 | 43.8 |
| PIP-72Gh | — | — | — | — | — | — | — | 55.2 |
| PIP-72Gi | — | — | — | — | — | — | — | — |
| BTI_1023 | — | — | — | — | — | — | — | — |
| PIP-72Gk | — | — | — | — | — | — | — | — |
| PIP-72Gl | — | — | — | — | — | — | — | — |
| PIP-72Gm | — | — | — | — | — | — | — | — |
| PIP-72Gn | — | — | — | — | — | — | — | — |
| WP_028536646 | — | — | — | — | — | — | — | — |
| BTRA_1468 | — | — | — | — | — | — | — | — |
| JG43047 | — | — | — | — | — | — | — | — |
| PFL_6283 | — | — | — | — | — | — | — | — |
| PIP-72Ba | — | — | — | — | — | — | — | — |
| PIP-72Ca | — | — | — | — | — | — | — | — |
| PIP-72Cb | — | — | — | — | — | — | — | — |
| PIP-72Da | — | — | — | — | — | — | — | — |
| PIP-72Db | — | — | — | — | — | — | — | — |
| PIP-72Dc | — | — | — | — | — | — | — | — |
| PIP-72Ea | — | — | — | — | — | — | — | — |
| PIP-72Fa | — | — | — | — | — | — | — | — |
| PIP-72Ff | — | — | — | — | — | — | — | — |
| PIP-72Gb | — | — | — | — | — | — | — | — |
| PIP-72Ge | — | — | — | — | — | — | — | — |
| Plu2373 | — | — | — | — | — | — | — | — |
| SRBS_294080 | — | — | — | — | — | — | — | — |
| SwiRh_4910 | — | — | — | — | — | — | — | — |
| XBJ1_1078 | — | — | — | — | — | — | — | — |

| | BTI_1023 SEQ ID NO: 942 | PIP-72Gk SEQ ID NO: 943 | PIP-72Gl SEQ ID NO: 944 | PIP_72Gm SEQ ID NO: 945 | PIP-72Gn SEQ ID NO: 946 | WP_028536646 SEQ ID NO: 947 | BTRA_1468 SEQ ID NO: 948 | JG43047 SEQ ID NO: 24 |
|---|---|---|---|---|---|---|---|---|
| PIP-72Aa (SEQ ID NO: 2) | 30.0 | 37.4 | 39.6 | 37.8 | 33.7 | 40.0 | 31.1 | 35.7 |
| GBP_A3175 | 77.8 | 43.2 | 37.6 | 39.1 | 37.4 | 34.4 | 77.8 | 37.4 |
| PIP-72Ab | 30.0 | 38.5 | 39.6 | 35.6 | 31.6 | 35.2 | 32.2 | 33.7 |
| PIP-72Bb | 32.2 | 39.6 | 40.7 | 36.7 | 29.6 | 36.7 | 33.3 | 31.6 |
| WP_030131237 | 34.4 | 37.4 | 37.4 | 35.6 | 32.7 | 36.4 | 35.6 | 34.7 |
| WP_016417435 | 35.6 | 34.1 | 33.0 | 35.5 | 33.7 | 35.6 | 36.7 | 34.7 |
| BDL_2850 | 80.0 | 42.1 | 36.6 | 38.0 | 37.4 | 34.4 | 80.0 | 37.4 |
| PIP-72Fh | 29.0 | 53.3 | 94.5 | 56.0 | 52.0 | 24.2 | 30.1 | 52.0 |
| PIP-72Fi | 32.3 | 53.3 | 98.9 | 56.0 | 54.1 | 24.2 | 33.3 | 53.1 |
| PIP-72Fj | 29.9 | 48.5 | 52.1 | 59.4 | 90.8 | 25.0 | 30.9 | 96.9 |

TABLE 7-continued

| | | | | | | | | |
|---|---|---|---|---|---|---|---|---|
| PIP-72Fk | 33.0 | 50.5 | 55.2 | 53.1 | 77.6 | 21.9 | 35.4 | 79.6 |
| PIP-72Fl | 31.9 | 28.3 | 27.2 | 35.9 | 34.3 | 30.9 | 34.1 | 32.3 |
| BBK_2354 | 78.9 | 43.2 | 36.6 | 39.1 | 37.4 | 33.3 | 78.9 | 37.4 |
| D512_15386 | 73.9 | 41.2 | 35.8 | 36.2 | 37.6 | 29.3 | 73.9 | 37.6 |
| PIP-72Gg | 28.1 | 46.9 | 41.7 | 67.4 | 48.5 | 21.2 | 28.4 | 48.5 |
| PIP-72Gh | 29.9 | 48.5 | 52.1 | 59.4 | 91.8 | 24.0 | 30.9 | 89.8 |
| PIP-72Gi | 31.2 | 53.3 | 95.6 | 58.2 | 55.1 | 23.1 | 32.3 | 55.1 |
| BTI_1023 | — | 34.7 | 31.2 | 30.4 | 29.3 | 28.1 | 94.7 | 29.3 |
| PIP-72Gk | — | — | 52.2 | 51.6 | 48.5 | 30.2 | 34.0 | 50.0 |
| PIP-72Gl | — | — | — | 56.0 | 53.1 | 24.2 | 32.3 | 52.0 |
| PIP-72Gm | — | — | — | — | 56.1 | 22.8 | 32.3 | 59.2 |
| PIP-72Gn | — | — | — | — | — | 22.4 | 30.3 | 90.8 |
| WP_028536646 | — | — | — | — | — | — | 29.2 | 23.5 |
| BTRA_1468 | — | — | — | — | — | — | — | 30.3 |
| JG43047 | — | — | — | — | — | — | — | — |
| PFL_6283 | — | — | — | — | — | — | — | — |
| PIP-72Ba | — | — | — | — | — | — | — | — |
| PIP-72Ca | — | — | — | — | — | — | — | — |
| PIP-72Cb | — | — | — | — | — | — | — | — |
| PIP-72Da | — | — | — | — | — | — | — | — |
| PIP-72Db | — | — | — | — | — | — | — | — |
| PIP-72Dc | — | — | — | — | — | — | — | — |
| PIP-72Ea | — | — | — | — | — | — | — | — |
| PIP-72Fa | — | — | — | — | — | — | — | — |
| PIP-72Ff | — | — | — | — | — | — | — | — |
| PIP-72Gb | — | — | — | — | — | — | — | — |
| PIP-72Ge | — | — | — | — | — | — | — | — |
| Plu2373 | — | — | — | — | — | — | — | — |
| SRBS_294080 | — | — | — | — | — | — | — | — |
| SwiRh_4910 | — | — | — | — | — | — | — | — |
| XBJ1_1078 | — | — | — | — | — | — | — | — |

| | PFL_6283 SEQ ID NO: 30 | PIP-72Ba SEQ ID NO: 4 | PIP-72Ca SEQ ID NO: 6 | PIP-72Cb SEQ ID NO: 8 | PIP-72Da SEQ ID NO: 10 | PIP-72Db SEQ ID NO: 12 | PIP-72Dc SEQ ID NO: 14 | PIP-72Ea SEQ ID NO: 16 |
|---|---|---|---|---|---|---|---|---|
| PIP-72Aa (SEQ ID NO: 2) | 34.8 | 83.7 | 72.1 | 69.8 | 68.6 | 69.8 | 69.8 | 51.7 |
| GBP_A3175 | 35.1 | 45.6 | 44.4 | 43.3 | 45.6 | 44.4 | 45.6 | 46.7 |
| PIP-72Ab | 32.6 | 82.6 | 69.8 | 67.4 | 66.3 | 67.4 | 67.4 | 52.9 |
| PIP-72Bb | 35.9 | 91.9 | 68.6 | 70.9 | 67.4 | 68.6 | 68.6 | 52.9 |
| WP_030131237 | 34.8 | 77.9 | 68.6 | 68.6 | 67.4 | 68.6 | 67.4 | 50.6 |
| WP_016417435 | 35.9 | 51.7 | 47.7 | 46.5 | 47.7 | 46.5 | 47.7 | 43.7 |
| BDL_2850 | 34.0 | 44.4 | 43.3 | 42.2 | 44.4 | 43.3 | 44.4 | 46.7 |
| PIP-72Fh | 47.3 | 40.7 | 35.2 | 37.4 | 36.3 | 37.4 | 36.3 | 35.2 |
| PIP-72Fi | 44.1 | 40.7 | 36.3 | 38.5 | 37.4 | 38.5 | 37.4 | 35.2 |
| PIP-72Fj | 48.0 | 33.3 | 35.4 | 34.4 | 36.5 | 35.4 | 36.5 | 35.4 |
| PIP-72Fk | 43.9 | 35.4 | 34.4 | 33.3 | 35.4 | 34.4 | 35.4 | 35.4 |
| PIP-72Fl | 29.0 | 44.9 | 51.7 | 49.4 | 48.3 | 48.3 | 48.3 | 40.4 |
| BBK_2354 | 35.1 | 44.4 | 43.3 | 42.2 | 44.4 | 43.3 | 44.4 | 46.7 |
| D512_15386 | 35.1 | 40.2 | 39.1 | 38.0 | 40.2 | 39.1 | 40.2 | 45.7 |
| PIP-72Gg | 69.5 | 35.8 | 31.6 | 32.6 | 32.3 | 31.2 | 32.3 | 34.4 |
| PIP-72Gh | 48.0 | 31.2 | 33.3 | 32.3 | 34.4 | 33.3 | 34.4 | 35.4 |
| PIP-72Gi | 46.2 | 38.5 | 34.1 | 36.3 | 35.2 | 36.3 | 35.2 | 33.0 |
| BTI_1023 | 27.7 | 31.1 | 33.3 | 32.2 | 35.6 | 34.4 | 35.6 | 36.7 |
| PIP-72Gk | 47.3 | 40.7 | 39.6 | 41.8 | 40.7 | 39.6 | 40.7 | 33.7 |
| PIP-72Gl | 45.2 | 40.7 | 36.3 | 38.5 | 37.4 | 38.5 | 37.4 | 35.2 |
| PIP-72Gm | 66.3 | 37.8 | 37.4 | 38.5 | 39.6 | 38.5 | 39.6 | 37.4 |
| PIP-72Gn | 46.0 | 31.6 | 33.7 | 32.7 | 34.7 | 33.7 | 34.7 | 34.7 |
| WP_028536646 | 24.5 | 36.3 | 38.5 | 38.5 | 36.0 | 37.2 | 36.0 | 30.1 |
| BTRA_1468 | 28.7 | 32.2 | 34.4 | 33.3 | 35.6 | 34.4 | 35.6 | 37.8 |
| JG43047 | 48.0 | 33.7 | 33.7 | 32.7 | 34.7 | 33.7 | 34.7 | 34.7 |
| PFL_6283 | — | 35.9 | 33.7 | 34.8 | 34.8 | 33.7 | 34.8 | 35.9 |
| PIP-72Ba | — | — | 72.1 | 74.4 | 69.8 | 70.9 | 70.9 | 51.7 |
| PIP-72Ca | — | — | — | 97.7 | 93.0 | 93.0 | 91.9 | 46.0 |
| PIP-72Cb | — | — | — | — | 93.0 | 93.0 | 91.9 | 44.8 |
| PIP-72Da | — | — | — | — | — | 97.7 | 98.8 | 44.8 |
| PIP-72Db | — | — | — | — | — | — | 97.7 | 46.0 |
| PIP-72Dc | — | — | — | — | — | — | — | 44.8 |
| PIP-72Ea | — | — | — | — | — | — | — | — |
| PIP-72Fa | — | — | — | — | — | — | — | — |
| PIP-72Ff | — | — | — | — | — | — | — | — |
| PIP-72Gb | — | — | — | — | — | — | — | — |
| PIP-72Ge | — | — | — | — | — | — | — | — |
| Plu2373 | — | — | — | — | — | — | — | — |
| SRBS_294080 | — | — | — | — | — | — | — | — |

TABLE 7-continued

|  | PIP-72Fa SEQ ID NO: 18 | PIP-72Ff SEQ ID NO: 28 | PIP-72Gb SEQ ID NO: 32 | PIP-72Ge SEQ ID NO: 38 | Plu2373 SEQ ID NO: 36 | SRBS_294080 SEQ ID NO: 22 | SwiRh_4910 SEQ ID NO: 26 | XBJ1_1078 SEQ ID NO: 34 |
|---|---|---|---|---|---|---|---|---|
| SwiRh_4910 | — | — | — | — | — | — | — | — |
| X3J1_1078 | — | — | — | — | — | — | — | — |
| PIP-72Aa (SEQ ID NO: 2) | 38.5 | 36.7 | 34.4 | 33.7 | 38.9 | 41.1 | 38.9 | 36.7 |
| GBP_A3175 | 36.6 | 40.4 | 40.6 | 37.4 | 41.8 | 39.1 | 39.1 | 43.3 |
| PIP-72Ab | 38.5 | 34.7 | 32.3 | 31.6 | 39.4 | 38.9 | 36.7 | 35.6 |
| PIP-72Bb | 39.6 | 32.7 | 30.2 | 29.6 | 40.4 | 40.0 | 37.8 | 36.7 |
| WP_030131237 | 36.3 | 34.7 | 33.3 | 32.7 | 42.6 | 38.9 | 36.7 | 38.9 |
| WP_016417435 | 31.9 | 36.6 | 34.3 | 33.7 | 31.2 | 37.6 | 35.5 | 36.7 |
| BDL_2850 | 35.5 | 40.4 | 40.6 | 37.4 | 43.9 | 38.0 | 38.0 | 45.6 |
| PIP-72Fh | 95.6 | 54.1 | 53.1 | 52.0 | 24.0 | 56.0 | 57.1 | 31.5 |
| PIP-72Fi | 97.8 | 55.1 | 54.2 | 53.1 | 25.3 | 56.0 | 57.1 | 30.4 |
| PIP-72Fj | 52.1 | 79.6 | 94.8 | 90.8 | 31.7 | 58.3 | 59.4 | 28.1 |
| PIP-72Fk | 55.2 | 96.9 | 78.1 | 80.6 | 32.7 | 54.2 | 54.2 | 28.1 |
| PIP-72Fl | 27.2 | 32.3 | 35.1 | 35.4 | 32.3 | 34.1 | 35.9 | 31.5 |
| BBK_2354 | 35.5 | 40.4 | 40.6 | 37.4 | 42.9 | 39.1 | 39.1 | 44.4 |
| D512_15386 | 34.7 | 38.6 | 40.8 | 37.6 | 38.0 | 36.2 | 36.2 | 40.2 |
| PIP-72Gg | 41.7 | 42.7 | 49.5 | 49.5 | 27.9 | 63.2 | 67.4 | 28.4 |
| PIP-72Gh | 52.1 | 79.6 | 92.7 | 95.9 | 30.8 | 58.3 | 59.4 | 28.1 |
| PIP-72Gi | 96.7 | 57.1 | 56.2 | 55.1 | 24.0 | 58.2 | 59.3 | 29.3 |
| BTI_1023 | 31.2 | 32.3 | 32.3 | 29.3 | 36.1 | 30.4 | 30.4 | 37.5 |
| PIP-72Gk | 52.2 | 52.0 | 49.5 | 50.0 | 33.3 | 50.5 | 51.6 | 31.9 |
| PIP-72Gl | 98.9 | 54.1 | 53.1 | 52.0 | 24.0 | 56.0 | 57.1 | 30.4 |
| PIP-72Gm | 56.0 | 53.1 | 59.4 | 58.2 | 31.3 | 93.3 | 98.9 | 31.9 |
| PIP-72Gn | 53.1 | 79.6 | 92.9 | 94.9 | 30.2 | 55.1 | 56.1 | 27.6 |
| WP_028536646 | 24.2 | 21.4 | 24.0 | 23.5 | 34.7 | 23.3 | 22.8 | 37.1 |
| BTRA_1468 | 32.3 | 34.7 | 30.9 | 30.3 | 37.1 | 32.3 | 32.3 | 38.6 |
| JG43047 | 52.0 | 82.7 | 91.8 | 91.8 | 32.1 | 58.2 | 59.2 | 27.6 |
| PFL_6283 | 45.2 | 44.0 | 48.0 | 47.0 | 22.9 | 63.0 | 67.4 | 29.0 |
| PIP-72Ba | 39.6 | 34.7 | 32.3 | 31.6 | 41.5 | 41.1 | 38.9 | 35.6 |
| PIP-72Ca | 35.2 | 33.7 | 34.4 | 33.7 | 40.4 | 35.6 | 37.4 | 37.8 |
| PIP-72Cb | 37.4 | 32.7 | 33.3 | 32.7 | 40.4 | 36.7 | 38.5 | 37.8 |
| PIP-72Da | 36.3 | 34.7 | 35.4 | 34.7 | 41.5 | 37.8 | 39.6 | 34.4 |
| PIP-72Db | 37.4 | 33.7 | 34.4 | 33.7 | 39.4 | 36.7 | 38.5 | 35.6 |
| PIP-72Dc | 36.3 | 34.7 | 35.4 | 34.7 | 41.5 | 37.8 | 39.6 | 34.4 |
| PIP-72Ea | 34.1 | 34.7 | 35.4 | 34.7 | 35.8 | 35.6 | 37.4 | 35.6 |
| PIP-72Fa | — | 54.1 | 53.1 | 52.0 | 24.0 | 56.0 | 57.1 | 30.4 |
| PIP-72Ff | — | — | 77.6 | 83.7 | 32.1 | 54.1 | 54.1 | 27.6 |
| PIP-72Gb | — | — | — | 92.9 | 30.8 | 58.3 | 59.4 | 28.1 |
| PIP-72Ge | — | — | — | — | 30.2 | 57.1 | 58.2 | 27.6 |
| Plu2373 | — | — | — | — | — | 31.6 | 31.3 | 41.2 |
| SRBS_294080 | — | — | — | — | — | — | 94.4 | 33.0 |
| SwiRh_4910 | — | — | — | — | — | — | — | 31.9 |
| X3J1_1078 | — | — | — | — | — | — | — | — |

Example 3—*E. coli* Expression of PIP-72Aa and Homologs

The PIP-72Aa gene was amplified by PCR using genomic DNA isolated from strain SS143D5: forward primer (SEQ ID NO: 39) and reverse primer (SEQ ID NO: 40). The resulting PCR product was DNA sequence verified and subcloned into pCOLD™ 1 (Takara Bio Inc., Seta 3-4-1, Otsu, Shiga, Japan 520-2193) in frame with an N-terminal His-6 tag followed by a Factor Xa cleavage site. The polynucleotides encoding PIP-72Aa homologs identified from internal strains (PIP-72Ba, PIP-72Ca, PIP-72Cb, PIP-72 Da, PIP-72Db, PIP-72Dc, PIP-72Db, PIP-72Ea, PIP-72Fa, JG43047, IDP072Ff, PFL_6283, PIP-72Gb, PIP-72Ge) were cloned as described above, using their respective genomic DNA preparation as template for gene amplification by PCR and the primer sequences indicated in Table 8.

Homologs of PIP-72Aa which were identified from external databases (GBP_A3175, SRBS_294080, SwiRh_4910, XBJ1_1078, Plu2373, WP_030131237, and WP_016417435) were obtained through gene synthesis with compatible 5' and 3' ends for downstream cloning into pCOLD™-1.

TABLE 8

| gene | forward primer | reverse primer |
|---|---|---|
| PIP-72Ba | SEQ ID NO: 41 | SEQ ID NO: 42 |
| PIP-72Ca | SEQ ID NO: 43 | SEQ ID NO: 44 |
| PIP-72Cb | SEQ ID NO: 45 | SEQ ID NO: 46 |
| PIP-72Da | SEQ ID NO: 47 | SEQ ID NO: 48 |
| PIP-72Dc | SEQ ID NO: 49 | SEQ ID NO: 50 |
| PIP-72Db | SEQ ID NO: 51 | SEQ ID NO: 52 |
| PIP-72Ea | SEQ ID NO: 53 | SEQ ID NO: 54 |
| PIP-72Fa | SEQ ID NO: 55 | SEQ ID NO: 56 |
| JG43047 | SEQ ID NO: 57 | SEQ ID NO: 58 |
| PIP-72Ff | SEQ ID NO: 59 | SEQ ID NO: 60 |
| PFL_6283 | SEQ ID NO: 61 | SEQ ID NO: 62 |
| PIP-72Gb | SEQ ID NO: 63 | SEQ ID NO: 64 |
| PIP-72Ge | SEQ ID NO: 65 | SEQ ID NO: 66 |
| PIP-72Ge | SEQ ID NO: 67 | SEQ ID NO: 68 |
| PIP-72Ab | SEQ ID NO: 971 | SEQ ID NO: 972 |
| PIP-72Bb | SEQ ID NO: 973 | SEQ ID NO: 974 |
| PIP-72Fi | SEQ ID NO: 975 | SEQ ID NO: 976 |
| PIP-72Gh | SEQ ID NO: 977 | SEQ ID NO: 978 |
| PIP-72Gg | SEQ ID NO: 979 | SEQ ID NO: 980 |

Competent BL21-DE3 *E. coli* cells were transformed with pCOLD™-1 plasmid DNA, containing the respective PIP-72 gene insert for recombinant protein expression. The transformed *E. coli* cells were grown overnight at 37° C. with carbenicillin selection and then inoculated to a fresh 2×YT medium (1:25) and further grown to an optical density of about 0.8. The cells were then chilled in the presence of 1 mM ITPG and further grown at 16° C. for 16 hours to induce protein expression. The *E. coli* expressed proteins were purified by immobilized metal ion chromatography using Ni-NTA agarose (Qiagen®, Germany) according to the manufacturer's protocols.

Example 4—Insect Activity of PIP-72Aa and Homologs

A series of concentrations of the purified protein sample was assayed against Coleoptera insects and concentrations for 50% mortality (LC50) or inhibition of 50% of the individuals (IC50) were calculated in two independent experiments. The WCRW results for PIP-72Aa (SEQ ID NO: 2) are shown in Table 9.

TABLE 9

|  | ppm | 95% confidence interval (ppm) |
|---|---|---|
| LC50 | 80 | 30-130 |
| IC50 | 20 | 10-40 |

To measure insecticidal activities of other PIP-72 polypeptides, WCRW (*Diabrotica virgifera virgifera*) bioassays were conducted using 20 ul of the purified protein samples applied topically over 75 ul artificial WCRW diet (Bio-Serv F9800B based) in each of a 96 well bioassay plate (BD Falcon 353910) then air dried. A variable number of neonate *Diabrotica virgifera virgifera* neonates (3 to 9) were placed into each well of the 96 well plate. The assay was run for 4 days at 25° C. with no light and then scored for mortality and stunting. The WCRW insecticidal activity for the various PIP-72 polypeptides is shown in Table 10.

PIP-72Aa (SEQ ID NO: 2) was further tested against Southern Corn Root Worm (*Diabrotica undecimpunctata howardi*) and San Antonio beetle (*Diabrotica speciosa*) as well as against the sucking insect *Lygus hesperus*. PIP-72Aa (SEQ ID NO: 2) was not insecticidal against these pests at the concentrations tested (up to 875 ppm of purified protein).

Several PIP-72 polypeptides were also tested against SCRW (*Diabrotica undecimpunctata* howardi). Bioassays were conducted using 10 ul of the purified protein samples mixed with 50 ul artificial SCRW diet (Bio-Serv F9800B based) in each of a 96 well bioassay plate (BD Falcon 353910). A variable number of neonate *Diabrotica undecimpunctata* howardi neonates (3 to 5) were placed into each well of the 96 well plate. The assay was run for 4 days at 25° C. with no light and then scored for mortality and stunting.

TABLE 10

|  | WCRW activity, effect | highest conc. tested, ug/cm2 (ppm) | IC50, ug/cm2 | IC50, ppm |
|---|---|---|---|---|
| PIP-72Aa SEQ ID NO: 2 | active, death | 300 | 5-15 | 10-40 |
| PIP-72Ab SEQ ID NO: 927 | active, death | 1000 |  | 50 |
| PIP-72Ba SEQ ID NO: 4 | active, death | (1900) |  | 10-40 |
| PIP-72Bb SEQ ID NO: 928 | active, death | 1000 |  | 50 |
| PIP-72Ca SEQ ID NO: 6 | active, death | 1500 | 10-30 | 70 |
| PIP-72Cb SEQ ID NO: 8 | active, death | 1000 | 10-30 | 84 |
| PIP-72Da SEQ ID NO: 10 | active, death | (1666) | not tested in overlay format | 40-80 |
| PIP-72Db SEQ ID NO: 12 | active, death | 750 | 10-30 | 95 |
| PIP-72Dc SEQ ID NO: 14 | active, death | 450 | 5-15 | ~100 |
| PIP-72Ea SEQ ID NO: 16 | Inactive at concentration tested | (2150) |  |  |
| PIP-72Fa SEQ ID NO: 18 | active, severe stunting | 1132 |  | 141 |
| PIP-72Fi SEQ ID NO: 933 | active, severe stunting | 1000 |  |  |
| PIP-72Gg SEQ ID NO: 939 | active, severe stunting | 1000 |  | 500 |
| PIP-72Gh SEQ ID NO: 940 | active, severe stunting | 1000 |  |  |
| GBP_A3175 SEQ ID NO: 20 | active, death | 224 |  | 15-30 |
| SRBS_294080 SEQ ID NO: 22 | not expressed | — |  |  |
| JG43047 SEQ ID NO: 24 | weakly active, mild stunting | 218 |  | >218 |
| SwiRh_4910 SEQ ID NO: 26 | Inactive at concentration tested | 708 |  | — |
| WP_030131237 SEQ ID NO: 929 | active, death |  |  | 400 |
| WP_016417435 SEQ ID NO: 930 | inactive, low expression |  |  |  |
| PIP-72Ff SEQ ID NO: 28 | weakly active, stunting | 565 |  | ~500 |
| PFL_6283 SEQ ID NO: 30 | weakly active, mild stunting | 414 |  | >414 |
| PIP-72Gb SEQ ID NO: 32 | active, severe stunting | 571 |  | 71 |
| XBJ1_1078 SEQ ID NO: 34 | inactive | 97 |  | — |
| Plu2373 SEQ ID NO: 36 | not expressed | — |  | — |
| PIP-72Ge SEQ ID NO: 38 | inactive | 457 |  | — |

Lepidoptera feeding assays were conducted on an artificial diet in a 96 well plate set up. The purified protein was incorporated with the Lepidopteran-specific artificial diet in a ratio of 10 ul cleared lysate and 40 ul of diet mixture. Two to five neonate larvas were placed in each well to feed ad libitum for 5 days. Results were expressed as positive for larvae reactions such as stunting and or mortality. Results were expressed as negative if the larvae were similar to the negative control that is feeding diet to which the above buffer only has been applied.

PIP-72Aa (SEQ ID NO: 2), PFL_6283 (SEQ ID NO: 30), PIP-72 Da (SEQ ID NO: 10), PIP-72Fa (SEQ ID NO: 18) and PIP-72Gb (SEQ ID NO: 32) were assayed on European corn borer (*Ostrinia nubilalis*), corn earworm (*Helicoverpa zea*), black cutworm (*Agrotis ipsilon*), fall armyworm (*Spodoptera frugiperda*) and Soybean looper (*Pseudoplusia*

*includens*). No activity against the Lepidoptera species was seen for any of the PIP-72 polypeptides tested at protein concentrations up to 800 ppm.

Example 5—Lack of Cross Resistance of PIP-72Aa in mCry3A Resistant Strain of WCRW The WCRW strain resistant to mCry3A was developed by selections of WCRW on mCry3A transgenic maize plants with T0 expression level of mCry3A at >10,000 ppm of total proteins in roots. Seven selections were made on F3, F6, F7, F8, F10, F12, F14 larvae. F16 eggs of the Cry3A-resistant insects had a resistance ratio (RR) of >46-fold to mCry3A compared with the susceptible laboratory colony, and were used for cross resistance testing of PIP-72Aa (SEQ ID NO: 2). Standardized WCRW diet incorporation bioassays were utilized to evaluate the effects of PIP-72Aa (SEQ ID NO: 2) on WCRW larvae. WCRW neonate larvae were placed on the plates containing the bioassay diet and insecticidal protein with 4 replicates for each concentration treatment for 3 days after initiation of each bioassay. Insect mortality and severe stunting was scored and used to calculate inhibitory concentrations (IC50 and LC50) based on probit analysis. The resistance ratio (RR) was calculated as follows: RR=(LC/IC50 of resistant WCRW)/(LC/IC50 of susceptible WCRW). As shown in Table 11 Cry3A-resistant WCRW insects were sensitive to PIP-72Aa (SEQ ID NO: 2).

TABLE 11

| WCRW colony | LC/IC | PIP-72Aa (SEQ ID NO: 2), ppm | 95% CL | Resistance Ratio |
|---|---|---|---|---|
| Cry3A sensitive | LC50 | 168.9 | 97.81-429.5 | 1 |
|  | IC50 | 15.38 | 11.64-19.68 | 1 |
| Cry3A resistant | LC50 | 212.3 | 102.9-1071 | 1.3 |
|  | IC50 | 25.97 | 17.71-38.35 | 1.7 |

Example 6—*Agrobacterium*-Mediated Stable Transformation of Maize

For *Agrobacterium*-mediated maize transformation PIP-72 polypeptides, the method of Zhao was employed (U.S. Pat. No. 5,981,840 and International Patent Publication Number WO 1998/32326, the contents of which are hereby incorporated by reference). Briefly, immature embryos were isolated from maize and the embryos contacted with an *Agrobacterium* Suspension, where the bacteria were capable of transferring a polynucleotide encoding a PIP-72 polypeptide to at least one cell of at least one of the immature embryos (step 1: the infection step). In this step the immature embryos were immersed in an *Agrobacterium* suspension for the initiation of inoculation. The embryos were co-cultured for a time with the *Agrobacterium* (step 2: the co-cultivation step). The immature embryos were cultured on solid medium with antibiotic, but without a selecting agent, for *Agrobacterium* elimination and for a resting phase for the infected cells. Next, inoculated embryos were cultured on medium containing a selective agent and growing transformed callus is recovered (step 4: the selection step). The immature embryos were cultured on solid medium with a selective agent resulting in the selective growth of transformed cells. The callus was then regenerated into plants (step 5: the regeneration step), and calli grown on selective medium were cultured on solid medium to regenerate the plants.

For detection of the PIP-72 polypeptide in leaf tissue 4 lyophilized leaf punches/sample were pulverized and resuspended in 100 µL PBS containing 0.1% TWEEN™ 20 (PBST), 1% beta-mercaoptoethanol containing 1 tablet/7 mL complete Mini proteinase inhibitor (Roche 1183615301). The suspension was sonicated for 2 min and then centrifuged at 4°, 20,000 g for 15 min. To a supernatant aliquot ⅓ volume of 3× NuPAGE® LDS Sample Buffer (Invitrogen™ (CA, USA), 1% B-ME containing 1 tablet/7 mL complete Mini proteinase inhibitor was added. The reaction was heated at 80° C. for 10 min and then centrifuged. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified rabbit anti-PIP-72Aa in PBST overnight. The membrane was rinsed three times with PBST and then incubated in PBST for 15 min and then two times 5 min before incubating for 2 hours in PBST with goat anti-rabbit-HRP for 3 hours. The detected proteins were visualized using ECL Western Blotting Reagents (GE Healthcare cat # RPN2106) and Kodak® Biomax® MR film. For detection of the PIP-72Aa protein in roots the roots were lyophilized and 2 mg powder per sample was resuspended in LDS, 1% beta-mercaptoethanol containing 1 tablet/7 mL Complete Mini proteinase inhibitor was added. The reaction was heated at 80° C. for 10 min and then centrifuged at 4° C., 20,000 g for 15 min. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified polyclonal rabbit anti-PIP-72Aa antibody in PBST overnight. The membrane was rinsed three times with PBST and then incubated in PBST for 15 min and then two times 5 min before incubating for 2 hours in PBST with goat anti-rabbit-HRP for 3 hrs. The antibody bound insecticidal proteins were detected using ECL™ Western Blotting Reagents (GE Healthcare cat #RPN2106) and Kodak® Biomax® MR film.

Transgenic maize plants positive for expression of the insecticidal proteins are tested for pesticidal activity using standard bioassays known in the art. Such methods include, for example, root excision bioassays and whole plant bioassays. See, e.g., US Patent Application Publication Number US 2003/0120054 and International Publication Number WO 2003/018810.

Example 7—Expression Vector Constructs for Expression of PIP-72Aa in Plants

The plant expression vectors, PHP61666, PHP61668, PHP61664 were constructed to include a transgene cassette containing the native PIP-72Aa (SEQ ID NO: 1), PIP-72Aa maize optimized variant 1 (SEQ ID NO: 850) and PIP-72Aa maize optimized variant 2 (SEQ ID NO: 851), respectively, under control of the *Mirabilis* Mosaic Virus (MMV) promoter [Dey N and Maiti I B, 1999, *Plant Mol. Biol.* 40(5):771-82] in combination with an enhancer element. Additional vectors, PHP64465, PHP64471, and PHP64468 expressing the PIP-72Aa (maize optimized Variant 1) under different promoter, intron and terminator combinations were also tested in transgenic maize events. PHP64465 expresses PIP-72Aa (Variant 1) under control of the maize polyubiquitin promoter and associated 5'UTR and intron (Christensen A H and Quail R H, 1996, *Transgenic Res* 5:213-218) combined with the 35S enhancer (Kay et al., 1987, *Science* 236(4806):1299-1302. PHP64471 and PHP64468 express Variant 1 under control of the Banana Streak Virus [BSV (AY)TR] promoter (Diehn S, Lu A L and Simmons C R, 2012, U.S. Pat. No. 8,338,662B2) with either the ZM-HPLV9 (Diehn S et al., 2011, US2011039696) or ZM-ADH1 intron (Callis et al, 1987, *Genes Develop* 1:1183-1200), respectively. PHP69828 expresses PIP-72Aa maize optimized variant 3 (SEQ ID NO: 853) with the same regulatory elements as in PHP64471.

These constructs were used to generate transgenic maize events to test for efficacy against corn rootworm provided by expression of PIP-72Aa (SEQ ID NO: 2).

T0 greenhouse efficacy results for events generated from these constructs are shown in FIG. 8. Efficacy for events derived from each of the constructs was observed relative to negative control events as measured by root protection from Western corn root worm. Root protection was measured according to the number of nodes of roots injured (CRWNIS=corn rootworm node injury score) using the method developed by Oleson, et al. (2005) [*J. Econ Entomol.* 98(1):1-8]. The root injury score is measured from "0" to "3" with "0" indicating no visible root injury, "1" indicating 1 node of root damage, "2" indicating 2 nodes or root damage, and "3" indicating a maximum score of 3 nodes of root damage. Intermediate scores (e.g. 1.5) indicate additional fractions of nodes of damage (e.g. one and a half nodes injured).

FIG. 8 shows that the majority of events from the test constructs (each represents a single event from the construct) performed better than the negative control with rootworm injury scores of <1.0. Several constructs such as PHP64471 and PHP64468 showed rootworm injury scores that averaged <0.2 across all events tested.

Example 8—PIP-72Aa Variants with Multiple Amino Acid Substitutions

To create variants of PIP-72Aa (SEQ ID NO: 2) with multiple amino acid changes, variant libraries were generated by synthetic DNA shuffling (Ness et al, 2002, *Nature Biotechnology* 20, 1251-5) of PIP-72Aa (SEQ ID NO: 1) and GBP_A3175 (SEQ ID NO: 19) or by site-directed mutagenesis (QuikChange™ Lightning technique or QuikChange™ II technique, Agilent, Santa Clara Calif.). An amino acid sequence alignment of PIP-72Aa (SEQ ID NO: 2) and GBP_A3175 (SEQ ID NO: 20) is shown in FIG. 5. Briefly, gene synthesis reactions were performed with oligonucleotides listed in Table 12.

TABLE 12

| Name | Sequence |
| --- | --- |
| oligo 10 | SEQ ID NO: 69 |
| oligo 103 | SEQ ID NO: 70 |
| oligo 104 | SEQ ID NO: 71 |
| oligo 105 | SEQ ID NO: 72 |
| oligo 106 | SEQ ID NO: 73 |
| oligo 107 | SEQ ID NO: 74 |
| oligo 108 | SEQ ID NO: 75 |
| oligo 109 | SEQ ID NO: 76 |
| oligo 110 | SEQ ID NO: 77 |
| oligo 111 | SEQ ID NO: 78 |
| oligo 112 | SEQ ID NO: 79 |
| oligo 113 | SEQ ID NO: 80 |

TABLE 12-continued

| Name | Sequence |
| --- | --- |
| oligo 114 | SEQ ID NO: 81 |
| oligo 115 | SEQ ID NO: 82 |
| oligo 116 | SEQ ID NO: 83 |
| oligo 117 | SEQ ID NO: 84 |
| oligo 118 | SEQ ID NO: 85 |
| oligo 119 | SEQ ID NO: 86 |
| oligo 120 | SEQ ID NO: 87 |
| oligo 121 | SEQ ID NO: 88 |
| oligo 122 | SEQ ID NO: 89 |
| oligo 123 | SEQ ID NO: 90 |
| oligo 124 | SEQ ID NO: 91 |
| oligo 125 | SEQ ID NO: 92 |
| oligo 126 | SEQ ID NO: 93 |
| oligo 127 | SEQ ID NO: 94 |
| oligo 128 | SEQ ID NO: 95 |
| oligo 129 | SEQ ID NO: 96 |
| oligo 130 | SEQ ID NO: 97 |
| oligo 131 | SEQ ID NO: 98 |
| oligo 132 | SEQ ID NO: 99 |
| oligo 133 | SEQ ID NO: 100 |
| oligo 134 | SEQ ID NO: 101 |
| oligo 135 | SEQ ID NO: 102 |
| oligo 136 | SEQ ID NO: 103 |
| oligo 137 | SEQ ID NO: 104 |
| oligo 138 | SEQ ID NO: 105 |
| oligo 139 | SEQ ID NO: 106 |
| oligo 140 | SEQ ID NO: 107 |
| oligo 141 | SEQ ID NO: 108 |
| oligo 142 | SEQ ID NO: 109 |
| oligo 143 | SEQ ID NO: 110 |
| oligo 144 | SEQ ID NO: 111 |
| oligo 145 | SEQ ID NO: 112 |
| oligo 146 | SEQ ID NO: 113 |
| oligo 147 | SEQ ID NO: 114 |
| oligo 148 | SEQ ID NO: 115 |
| oligo 149 | SEQ ID NO: 116 |
| oligo 150 | SEQ ID NO: 117 |
| oligo 151 | SEQ ID NO: 118 |
| oligo 152 | SEQ ID NO: 119 |
| oligo 153 | SEQ ID NO: 120 |
| oligo 154 | SEQ ID NO: 121 |
| oligo 155 | SEQ ID NO: 122 |
| oligo 156 | SEQ ID NO: 123 |
| oligo 157 | SEQ ID NO: 124 |
| oligo 158 | SEQ ID NO: 125 |
| oligo 159 | SEQ ID NO: 126 |
| oligo 160 | SEQ ID NO: 127 |
| oligo 161 | SEQ ID NO: 128 |
| oligo 162 | SEQ ID NO: 129 |
| oligo 163 | SEQ ID NO: 130 |
| oligo 164 | SEQ ID NO: 131 |
| oligo 165 | SEQ ID NO: 132 |
| oligo 166 | SEQ ID NO: 133 |
| oligo 167 | SEQ ID NO: 134 |
| oligo 168 | SEQ ID NO: 135 |
| oligo 169 | SEQ ID NO: 136 |
| oligo 170 | SEQ ID NO: 137 |
| oligo 171 | SEQ ID NO: 138 |
| oligo 172 | SEQ ID NO: 139 |
| oligo 173 | SEQ ID NO: 140 |
| oligo 174 | SEQ ID NO: 141 |
| oligo 175 | SEQ ID NO: 142 |

Several synthetic genes were generated using different primer sets as indicated in Table 13. Gene synthesis reactions F46, F31 and F39 each utilized sets of 10 discrete oligonucleotide primers. Gene synthesis reactions deg7, deg15, deg20 utilized sets of oligonucleotide primers with sequence degeneracy, resulting in libraries of sequences. Gene synthesis reactions F46, F31, F39, deg7, deg15 and deg20 were combined and screened as a single library.

TABLE 13

| Reaction | Primers |
|---|---|
| F46 | 10, 103, 104, 105, 106, 107, 108, 109, 110, 111 |
| deg7 | 10, 112, 113, 114, 115, 116, 117, 118, 119, 120 |
| deg15 | 10, 121, 122, 123, 124, 125, 126, 127, 128, 129 |
| F31 | 10, 130, 131, 132, 133, 134, 135, 136, 137, 138 |
| deg20 | 10, 139,140, 141, 142, 143, 144, 145, 146, 147, 148, 149, 150, 151, 152, 153, 154, 155, 156, 157, 158, 159, 160, 161, 162, 163, 164, 165, 166 |
| F39 | 10, 167, 168, 169, 170, 171, 172, 173, 174, 175 |

Synthetic gene fragments were subcloned in expression vector pCOLD™1 as described in Example 3. The resulting plasmid DNAs were transformed into E. coli, and protein was expressed as described in Example 3. Bioassays were performed on Western Corn Root Worm as described in Example 4 to determine which gene variants retained insecticidal activity. DNA sequencing was performed on the active gene variants. The nucleotide and amino acid sequences of the resulting active PIP-72 polypeptide variants are listed in Table 14. Five active variants were recovered from 59 unique variants that were screened. Table 15 shows the amino acid substitutions of the resulting active PIP-72 polypeptide variants compared to PIP-72Aa (SEQ ID NO: 2).

TABLE 14

| % Identity to PIP72Aa SEQ ID NO: 2 | Clone designation | Polynucleotide SEQ ID NO | Polypeptide SEQ ID NO |
|---|---|---|---|
| 53% | PIP-72Aa-Fb-01 | SEQ ID NO: 287 | SEQ ID NO: 528 |
| 48% | PIP-72Aa-Fb-09 | SEQ ID NO: 288 | SEQ ID NO: 529 |
| 56% | PIP-72Aa-Fb-27 | SEQ ID NO: 289 | SEQ ID NO: 530 |
| 57% | PIP-72Aa-Fb-28 | SEQ ID NO: 290 | SEQ ID NO: 531 |
| 67% | PIP-72Aa-Fb-33 | SEQ ID NO: 291 | SEQ ID NO: 532 |

TABLE 15

| Clone Designation | Polypeptide | Amino acid substitutions compared to PIP-72Aa (SEQ ID NO: 2) |
|---|---|---|
| PIP-72Aa-Fb-01 | SEQ ID NO: 528 | G002A, T004S, T006K, S009A, I013V, S022T, S027K, F028P, G032A, N033P, K035A, Q036S, E037D, T038S, S042N, S044L, L049M, S050Y, L051V, K052Q, K053L, N054G, A056S, Q057A, Q063L, A064S, S065T, K067N, E069V, V070I, D071Y, N072D, N073D, A074K, K076T, Q078S, R080Q, L081T, I082L, E083L |
| PIP-72Aa-Fb-09 | SEQ ID NO: 529 | G002A, T004S, T006K, N008S, S009A, P012T, I013V, A016S, S022T, S027K, F028P, S030K, V031M, G032A, N033P, K035A, Q036S, E037D, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| PIP-72Aa-Fb-27 | SEQ ID NO: 530 | G002A, T006K, N008S, S009A, P012T, A016S, S022T, S027K, F028P, S030K, G032A, N033P, K035A, Q036S, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, E083L |
| PIP-72Aa-Fb-28 | SEQ ID NO: 531 | G002A, T006K, N008S, S009A, P012T, A016S, S027K, F028P, S030K, G032A, N033P, K035A, Q036S, S042N, S044L, S050Y, K052Q, K053L, N054G, A056S, Q057A, H058T, Q063L, A064S, S065T, K067N, E069V, V070I, D071Y, N072D, N073D, A074K, K076T, Q078S, R080Q, L081T, E083L |
| PIP-72Aa-Fb-33 | SEQ ID NO: 532 | G002A, T004S, S009A, I013V, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |

To generate additional active PIP-72 polypeptides, further site-directed mutagenesis was performed using the polynucleotide sequences PIP-72Aa-Fb-9 (SEQ ID NO: 288), PIP-72Aa-Fb-27 (SEQ ID NO: 289) and PIP-72Aa-Fb-33 (SEQ ID NO: 291) as the templates by the QuikChange™ technique (Agilent, 5301 Stevens Creek Blvd., Santa Clara Calif.) using oligonucleotide primers listed in Table 16. Primers PIP-72Aa-Fb_9-27_1 (SEQ ID NO: 143), PIP-72Aa-Fb_9-27_2 (SEQ ID NO: 144), PIP-72Aa-Fb_9-27_3 (SEQ ID NO: 145), PIP-72Aa-Fb_9-27_12 (SEQ ID NO: 146), PIP-72Aa-Fb_9-27_13 (SEQ ID NO: 147), and PIP-72Aa-Fb_9-27_14 (SEQ ID NO: 148) were used for mutagenesis of plasmid DNA templates PIP-72Aa-Fb-09 (SEQ ID NO: 288) and PIP-72Aa-Fb-27 (SEQ ID NO: 289). Primers PIP-72Aa-Fb_33_1 through PIP-72Aa-Fb_33_11 (SEQ ID NO: 149 through SEQ ID NO: 159) were used for mutagenesis of plasmid DNA template PIP-72Aa-Fb-33 (SEQ ID NO: 291).

TABLE 16

| Primer Name | Sequence identifier |
|---|---|
| PIP-72Aa-Fb_9-27_1 | SEQ ID NO: 143 |
| PIP-72Aa-Fb_9-27_2 | SEQ ID NO: 144 |
| PIP-72Aa-Fb_9-27_3 | SEQ ID NO: 145 |
| PIP-72Aa-Fb_9-27_12 | SEQ ID NO: 146 |
| PIP-72Aa-Fb_9-27_13 | SEQ ID NO: 147 |
| PIP-72Aa-Fb_9-27_14 | SEQ ID NO: 148 |
| PIP-72Aa-Fb_33_1 | SEQ ID NO: 149 |
| PIP-72Aa-Fb_33_2 | SEQ ID NO: 150 |
| PIP-72Aa-Fb_33_3 | SEQ ID NO: 151 |
| PIP-72Aa-Fb_33_4 | SEQ ID NO: 152 |
| PIP-72Aa-Fb_33_5 | SEQ ID NO: 153 |
| PIP-72Aa-Fb_33_6 | SEQ ID NO: 154 |
| PIP-72Aa-Fb_33_7 | SEQ ID NO: 155 |
| PIP-72Aa-Fb_33_8 | SEQ ID NO: 156 |
| PIP-72Aa-Fb_33_9 | SEQ ID NO: 157 |
| PIP-72Aa-Fb_33_10 | SEQ ID NO: 158 |
| PIP-72Aa-Fb_33_11 | SEQ ID NO: 159 |
| PIP-72Aa-Fb_33_12 | SEQ ID NO: 160 |
| PIP-72Aa-Fb_33_13 | SEQ ID NO: 161 |
| PIP-72Aa-Fb_33_14 | SEQ ID NO: 162 |
| PIP-72Aa-Fb_33_15 | SEQ ID NO: 163 |
| PIP-72Aa-Fb_33_16 | SEQ ID NO: 164 |
| PIP-72Aa-Fb_33_17 | SEQ ID NO: 165 |
| PIP-72Aa-Fb_33_18 | SEQ ID NO: 166 |
| PIP-72Aa-Fb_33_19 | SEQ ID NO: 167 |
| PIP-72Aa-Fb_33_20 | SEQ ID NO: 168 |
| PIP-72Aa-Fb_33_21 | SEQ ID NO: 169 |
| PIP-72Aa-Fb_33_22 | SEQ ID NO: 170 |
| PIP-72Aa-Fb_33_9 | SEQ ID NO: 157 |
| PIP-72Aa-Fb_33_10 | SEQ ID NO: 158 |

The resulting plasmid DNAs were transformed into E. coli, and protein was expressed as described in Example 3.

Bioassays were performed on Western Corn Root Worm as described in Example 4 to determine which gene variants retained insecticidal activity. DNA sequencing was performed on the active gene variants. The percent identity compared to PIP-72Aa (SEQ ID NO: 2), clone identification, polynucleotide and polypeptide sequences of the resulting active variants are listed in Table 17. The PIP-72 polypeptide variants from PIP-72Aa-Fb-9 (SEQ ID NO: 530) yielded 33 active variants out of 72 that were screened. The PIP-72 polypeptide variants from PIP-72Aa-Fb-27 (SEQ ID NO: 530) yielded 11 active variants out of 52 that were screened. PIP-72 polypeptide variants from PIP-72Aa-Fb-33 (SEQ ID NO: 532) yielded 47 active variants out of 79 that were screened. Table 18 shows the amino acid substitutions of the resulting active PIP-72 polypeptide variants compared to PIP-72Aa (SEQ ID NO: 2).

TABLE 17

| % Identity to PIP-72Aa | Clone designation | Polynucleotide SEQ ID NO | Polypeptide SEQ ID NO: |
| --- | --- | --- | --- |
| 55% | D_D0414317 | SEQ ID NO: 292 | SEQ ID NO: 533 |
| 56% | D_D0414326 | SEQ ID NO: 293 | SEQ ID NO: 534 |
| 57% | D_D0414327 | SEQ ID NO: 294 | SEQ ID NO: 535 |
| 55% | D_D0414355 | SEQ ID NO: 295 | SEQ ID NO: 536 |
| 53% | D_D0414366 | SEQ ID NO: 296 | SEQ ID NO: 537 |
| 57% | D_D0414388 | SEQ ID NO: 297 | SEQ ID NO: 538 |
| 52% | D_D0414411 | SEQ ID NO: 298 | SEQ ID NO: 539 |
| 53% | D_D0414412 | SEQ ID NO: 299 | SEQ ID NO: 540 |
| 49% | D_D0414416 | SEQ ID NO: 300 | SEQ ID NO: 541 |
| 48% | D_D0414422 | SEQ ID NO: 301 | SEQ ID NO: 542 |
| 50% | D_D0414424 | SEQ ID NO: 302 | SEQ ID NO: 543 |
| 49% | D_D0414425 | SEQ ID NO: 303 | SEQ ID NO: 544 |
| 53% | D_D0414427 | SEQ ID NO: 304 | SEQ ID NO: 545 |
| 46% | D_D0414430 | SEQ ID NO: 305 | SEQ ID NO: 546 |
| 51% | D_D0414433 | SEQ ID NO: 306 | SEQ ID NO: 547 |
| 50% | D_D0414439 | SEQ ID NO: 307 | SEQ ID NO: 548 |
| 49% | D_D0414449 | SEQ ID NO: 308 | SEQ ID NO: 549 |
| 49% | D_D0414450 | SEQ ID NO: 309 | SEQ ID NO: 550 |
| 49% | D_D0414453 | SEQ ID NO: 310 | SEQ ID NO: 551 |
| 48% | D_D0414454 | SEQ ID NO: 311 | SEQ ID NO: 552 |
| 52% | D_D0414455 | SEQ ID NO: 312 | SEQ ID NO: 553 |
| 50% | D_D0414459 | SEQ ID NO: 313 | SEQ ID NO: 554 |
| 48% | D_D0414462 | SEQ ID NO: 314 | SEQ ID NO: 555 |
| 50% | D_D0414466 | SEQ ID NO: 315 | SEQ ID NO: 556 |
| 51% | D_D0414470 | SEQ ID NO: 316 | SEQ ID NO: 557 |
| 49% | D_D0414471 | SEQ ID NO: 317 | SEQ ID NO: 558 |
| 51% | D_D0414475 | SEQ ID NO: 318 | SEQ ID NO: 559 |
| 50% | D_D0414479 | SEQ ID NO: 319 | SEQ ID NO: 560 |
| 51% | D_D0414486 | SEQ ID NO: 320 | SEQ ID NO: 561 |
| 50% | D_D0414489 | SEQ ID NO: 321 | SEQ ID NO: 562 |
| 50% | D_D0414493 | SEQ ID NO: 322 | SEQ ID NO: 563 |
| 69% | D_D0419050 | SEQ ID NO: 323 | SEQ ID NO: 564 |
| 70% | D_D0419051 | SEQ ID NO: 324 | SEQ ID NO: 565 |
| 70% | D_D0419053 | SEQ ID NO: 325 | SEQ ID NO: 566 |
| 69% | D_D0419057 | SEQ ID NO: 326 | SEQ ID NO: 567 |
| 71% | D_D0419058 | SEQ ID NO: 327 | SEQ ID NO: 568 |
| 66% | D_D0419060 | SEQ ID NO: 328 | SEQ ID NO: 569 |
| 71% | D_D0419062 | SEQ ID NO: 329 | SEQ ID NO: 570 |
| 70% | D_D0419064 | SEQ ID NO: 330 | SEQ ID NO: 571 |
| 66% | D_D0419066 | SEQ ID NO: 331 | SEQ ID NO: 572 |
| 69% | D_D0419071 | SEQ ID NO: 332 | SEQ ID NO: 573 |
| 70% | D_D0419072 | SEQ ID NO: 333 | SEQ ID NO: 574 |
| 69% | D_D0419075 | SEQ ID NO: 334 | SEQ ID NO: 575 |
| 72% | D_D0419077 | SEQ ID NO: 335 | SEQ ID NO: 576 |
| 71% | D_D0419082 | SEQ ID NO: 336 | SEQ ID NO: 577 |
| 69% | D_D0419083 | SEQ ID NO: 337 | SEQ ID NO: 578 |
| 66% | D_D0419084 | SEQ ID NO: 338 | SEQ ID NO: 579 |
| 70% | D_D0419087 | SEQ ID NO: 339 | SEQ ID NO: 580 |
| 69% | D_D0419091 | SEQ ID NO: 340 | SEQ ID NO: 581 |
| 73% | D_D0419093 | SEQ ID NO: 341 | SEQ ID NO: 582 |
| 70% | D_D0419095 | SEQ ID NO: 342 | SEQ ID NO: 583 |
| 71% | D_D0419096 | SEQ ID NO: 343 | SEQ ID NO: 584 |
| 70% | D_D0419098 | SEQ ID NO: 344 | SEQ ID NO: 585 |
| 70% | D_D0419099 | SEQ ID NO: 345 | SEQ ID NO: 586 |
| 70% | D_D0419101 | SEQ ID NO: 346 | SEQ ID NO: 587 |
| 69% | D_D0419102 | SEQ ID NO: 347 | SEQ ID NO: 588 |

TABLE 17-continued

| % Identity to PIP-72Aa | Clone designation | Polynucleotide SEQ ID NO | Polypeptide SEQ ID NO: |
| --- | --- | --- | --- |
| 71% | D_D0419106 | SEQ ID NO: 348 | SEQ ID NO: 589 |
| 70% | D_D0419108 | SEQ ID NO: 349 | SEQ ID NO: 590 |
| 67% | D_D0419109 | SEQ ID NO: 350 | SEQ ID NO: 591 |
| 67% | D_D0419110 | SEQ ID NO: 351 | SEQ ID NO: 592 |
| 69% | D_D0419111 | SEQ ID NO: 352 | SEQ ID NO: 593 |
| 67% | D_D0419114 | SEQ ID NO: 353 | SEQ ID NO: 594 |
| 70% | D_D0419115 | SEQ ID NO: 354 | SEQ ID NO: 595 |
| 72% | D_D0419117 | SEQ ID NO: 355 | SEQ ID NO: 596 |
| 74% | D_D0419118 | SEQ ID NO: 356 | SEQ ID NO: 597 |
| 67% | D_D0419119 | SEQ ID NO: 357 | SEQ ID NO: 598 |
| 69% | D_D0419120 | SEQ ID NO: 358 | SEQ ID NO: 599 |
| 72% | D_D0419124 | SEQ ID NO: 359 | SEQ ID NO: 600 |
| 72% | D_D0419126 | SEQ ID NO: 360 | SEQ ID NO: 601 |
| 71% | D_D0419127 | SEQ ID NO: 361 | SEQ ID NO: 602 |
| 70% | D_D0419128 | SEQ ID NO: 362 | SEQ ID NO: 603 |
| 71% | D_D0419132 | SEQ ID NO: 363 | SEQ ID NO: 604 |
| 69% | D_D0419138 | SEQ ID NO: 364 | SEQ ID NO: 605 |
| 65% | D_D0419142 | SEQ ID NO: 365 | SEQ ID NO: 606 |
| 69% | D_D0419145 | SEQ ID NO: 366 | SEQ ID NO: 607 |

TABLE 18

| Clone Designation | Polypeptide | Amino acid substitutions compared to PIP-72Aa (SEQ ID NO: 2) |
| --- | --- | --- |
| D_D0414317 | SEQ ID NO: 533 | G002A, T004S, T006K, N008S, S009A, P012T, I013V, S022T, S027K, F028P, S030K, G032A, N033P, K035A, Q036S, S042N, S044L, S050Y, L051V, K052Q, K053L, N054G, A056S, Q057A, H058T, Q063L, A064S, K067N, E069V, V070I, D071Y, N072D, N073D, A074K, K076T, Q078S, R080Q, L081T, E083L |
| D_D0414326 | SEQ ID NO: 534 | G002A, T006K, N008S, S009A, P012T, I013V, S022T, S027K, F028P, S030K, G032A, N033P, K035A, Q036S, S042N, S044L, S050Y, L051V, K052Q, K053L, N054G, A056S, Q057A, H058T, Q063L, A064S, K067N, E069V, V070I, D071Y, N072D, N073D, A074K, K076T, Q078S, R080Q, L081T, E083L |
| D_D0414327 | SEQ ID NO: 535 | G002A, T006K, N008S, S009A, P012T, S022T, S027K, F028P, S030K, G032A, N033P, K035A, Q036S, S042N, S044L, L049M, S050Y, L051V, K053L, N054G, A056S, Q057A, H058T, Q063L, A064S, K067N, E069V, V070I, D071Y, N072D, N073D, A074K, K076T, Q078S, R080Q, L081T, E083L |
| D_D0414355 | SEQ ID NO: 536 | G002A, T006K, N008S, S009A, P012T, A016S, S022T, S027K, F028P, S030K, G032A, N033P, K035A, Q036S, S042N, S044L, L049M, S050Y, L051V, K052Q, K053L, N054G, A056S, Q057A, H058T, Q063L, A064S, K067N, E069V, V070I, D071Y, N072D, N073D, A074K, K076T, Q078S, R080Q, L081T, E083L |
| D_D0414366 | SEQ ID NO: 537 | G002A, T006K, N008S, S009A, P012T, A016S, S022T, S027K, F028P, S030K, G032A, N033P, K035A, Q036S, E037D, T038S, S042N, S044L, S050Y, L051V, K052Q, K053L, N054G, A056S, Q057A, H058T, Q063L, A064S, K067N, E069V, V070I, D071Y, N072D, N073D, A074K, K076T, Q078S, R080Q, L081T, E083L |
| D_D0414388 | SEQ ID NO: 538 | G002A, T004S, T006K, N008S, P012T, S022T, S027K, F028P, S030K, G032A, N033P, K035A, Q036S, S042N, S044L, S050Y, L051V, K052Q, K053L, N054G, A056S, Q057A, H058T, Q063L, A064S, K067N, E069V, V070I, D071Y, N072D, N073D, A074K, K076T, Q078S, R080Q, L081T, E083L |

TABLE 18-continued

| Clone Designation | Polypeptide | Amino acid substitutions compared to PIP-72Aa (SEQ ID NO: 2) |
|---|---|---|
| D_D0414411 | SEQ ID NO: 539 | G002A, T006K, P012T, A016S, S022T, S027K, F028P, S030K, V031M, G032A, N033P, K035A, Q036S, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414412 | SEQ ID NO: 540 | G002A, T006K, S009A, P012T, S022T, S027K, F028P, S030K, V031M, G032A, N033P, K035A, Q036S, T038S, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414416 | SEQ ID NO: 541 | G002A, T004S, T006K, N008S, P012T, I013V, A016S, S022T, S027K, F028P, S030K, V031M, G032A, N033P, K035A, Q036S, E037D, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414422 | SEQ ID NO: 542 | G002A, T004S, T006K, N008S, S009A, P012T, I013V, A016S, S022T, S027K, F028P, S030K, V031M, G032A, N033P, K035A, Q036S, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414424 | SEQ ID NO: 543 | G002A, T004S, T006K, N008S, P012T, A016S, S022T, S027K, F028P, S030K, V031M, G032A, N033P, K035A, Q036S, E037D, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414425 | SEQ ID NO: 544 | G002A, T004S, T006K, N008S, S009A, P012T, I013V, A016S, S022T, S027K, F028P, S030K, V031M, G032A, N033P, K035A, Q036S, E037D, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414427 | SEQ ID NO: 545 | G002A, T006K, N008S, P012T, S022T, S027K, F028P, S030K, V031M, G032A, N033P, K035A, Q036S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414430 | SEQ ID NO: 546 | G002A, T004S, T006K, N008S, S009A, P012T, I013V, A016S, S022T, S027K, F028P, S030K, V031M, G032A, N033P, K035A, Q036S, E037D, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414433 | SEQ ID NO: 547 | G002A, T004S, T006K, N008S, P012T, A016S, S022T, S027K, F028P, S030K, V031M, G032A, N033P, K035A, Q036S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414439 | SEQ ID NO: 548 | G002A, T004S, T006K, N008S, S009A, P012T, I013V, A016S, S022T, S027K, F028P, S030K, V031M, G032A, N033P, K035A, Q036S, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414449 | SEQ ID NO: 549 | G002A, T006K, N008S, S009A, P012T, I013V, A016S, S022T, S027K, F028P, S030K, V031M, G032A, N033P, K035A, Q036S, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414450 | SEQ ID NO: 550 | G002A, T004S, T006K, N008S, S009A, P012T, A016S, S022T, S027K, F028P, S030K, V031M, G032A, N033P, K035A, Q036S, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414453 | SEQ ID NO: 551 | G002A, T004S, T006K, N008S, S009A, P012T, I013V, A016S, S022T, S027K, F028P, S030K, V031M, G032A, N033P, K035A, Q036S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414454 | SEQ ID NO: 552 | G002A, T004S, T006K, N008S, S009A, P012T, I013V, A016S, S022T, S027K, F028P, S030K, V031M, G032A, N033P, K035A, Q036S, E037D, T038S, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414455 | SEQ ID NO: 553 | G002A, T006K, S009A, P012T, I013V, S022T, S027K, F028P, S030K, V031M, G032A, N033P, K035A, Q036S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414459 | SEQ ID NO: 554 | G002A, T006K, P012T, A016S, S022T, S027K, F028P, S030K, V031M, G032A, N033P, K035A, Q036S, E037D, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |

TABLE 18-continued

| Clone Designation | Polypeptide | Amino acid substitutions compared to PIP-72Aa (SEQ ID NO: 2) |
|---|---|---|
| D_D0414462 | SEQ ID NO: 555 | G002A, T004S, T006K, N008S, S009A, P012T, A016S, S022T, S027K, F028P, S030K, V031M, G032A, N033P, K035A, Q036S, E037D, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414466 | SEQ ID NO: 556 | G002A, T004S, T006K, N008S, P012T, I013V, S022T, S027K, F028P, S030K, V031M, G032A, N033P, K035A, Q036S, E037D, T038S, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414470 | SEQ ID NO: 557 | G002A, T006K, N008S, S009A, P012T, S022T, S027K, F028P, S030K, V031M, G032A, N033P, K035A, Q036S, E037D, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414471 | SEQ ID NO: 558 | G002A, T004S, T006K, N008S, S009A, P012T, I013V, A016S, S022T, S027K, F028P, S030K, V031M, G032A, N033P, K035A, Q036S, E037D, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414475 | SEQ ID NO: 559 | G002A, T004S, T006K, P012T, I013V, S022T, S027K, F028P, S030K, V031M, G032A, N033P, K035A, Q036S, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414479 | SEQ ID NO: 560 | G002A, T004S, T006K, N008S, P012T, I013V, S022T, S027K, F028P, S030K, V031M, G032A, N033P, K035A, Q036S, T038S, S042N, S044L, L049M, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414486 | SEQ ID NO: 561 | G002A, T004S, T006K, N008S, S009A, P012T, I013V, S022T, S027K, F028P, S030K, V031M, G032A, N033P, K035A, Q036S, E037D, S042N, S044L, L049M, S050Y, L051V, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414489 | SEQ ID NO: 562 | G002A, T004S, T006K, N008S, S009A, P012T, I013V, A016S, S022T, S027K, F028P, S030K, V031M, G032A, N033P, K035A, Q036S, E037D, S042N, S044L, S050Y, L051V, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0414493 | SEQ ID NO: 563 | G002A, T004S, T006K, N008S, P012T, I013V, A016S, S022T, S027K, F028P, S030K, V031M, G032A, N033P, K035A, Q036S, E037D, S042N, S044L, S050Y, L051V, K052Q, K053L, N054G, A056S, Q057A, H058T, Q063L, A064S, S065T, K067N, E069V, V070I, D071Y, N072D, N073D, A074K, K076T, Q078S, R080Q, L081T, I082L, E083L |
| D_D0419050 | SEQ ID NO: 564 | G002A, T004S, N008S, S009A, I013V, S022T, G032A, T038S, S044L, L049M, L051V, Q063L, A064S, S065T, K067N, E069V, V070I, D071Y, N072D, N073D, A074K, K076T, Q078S, R080Q, L081T, I082L, E083L |
| D_D0419051 | SEQ ID NO: 565 | G002A, T004S, S009A, I013V, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, E083L |
| D_D0419053 | SEQ ID NO: 566 | G002A, T004S, S009A, S022T, G032A, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419057 | SEQ ID NO: 567 | G002A, T004AS, S009A, I013V, S022T, G032A, E037D, T038S, S044L, L049M, L051V, Q063L, A064S, S065T, K067N, E069V, V070I, D071Y, N072D, N073D, A074K, K076T, Q078S, R080Q, L081T, I082L, E083L |
| D_D0419058 | SEQ ID NO: 568 | G002A, T004S, S009A, S022T, G032A, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419060 | SEQ ID NO: 569 | G002A, T004S, N008S, S009A, I013V, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419062 | SEQ ID NO: 570 | G002A, T004S, S009A, I013V, S022T, G032A, S044L, L051V, K052Q, Q063L, A064S, S065T, K067N, E069V, V070I, D071Y, N072D, N073D, A074K, K076T, Q078S, R080Q, L081T, I082L, E083L |
| D_D0419064 | SEQ ID NO: 571 | G002A, T004S, S009A, I013V, S022T, G032A, T038S, S044L, L051V, K052Q, Q063L, A064S, S065T, K067N, E069V, V070I, D071Y, N072D, N073D, A074K, K076T, Q078S, R080Q, L081T, I082L, E083L |
| D_D0419066 | SEQ ID NO: 572 | G002A, T004S, S009A, I013V, A016S, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419071 | SEQ ID NO: 573 | G002A, T004S, S009A, I013V, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L |
| D_D0419072 | SEQ ID NO: 574 | G002A, T004S, S009A, I013V, S022T, G032A, S044L, L049M, L051V, K052Q, Q063L, A064S, S065T, K067N, E069V, V070I, D071Y, N072D, N073D, A074K, K076T, Q078S, R080Q, L081T, I082L, E083L |

TABLE 18-continued

| Clone Designation | Polypeptide | Amino acid substitutions compared to PIP-72Aa (SEQ ID NO: 2) |
|---|---|---|
| D_D0419075 | SEQ ID NO: 575 | G002A, T004S, S009A, I013V, S022T, G032A, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419077 | SEQ ID NO: 576 | G002A, T004S, S022T, G032A, E037D, T038S, S044L, L051V, Q063L, A064S, S065T, K067N, E069V, V070I, D071Y, N072D, N073D, A074K, K076T, Q078S, R080Q, L081T, I082L, E083L |
| D_D0419082 | SEQ ID NO: 577 | G002A, T004S, S022T, G032A, E037D, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419083 | SEQ ID NO: 578 | G002A, T004S, S009A, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419084 | SEQ ID NO: 579 | G002A, T004S, N008S, S009A, I013V, A016S, S022T, G032A, E037D, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419087 | SEQ ID NO: 580 | G002A, T004S, S009A, I013V, A016S, S022T, G032A, S044L, L049M, L051V, K052Q, Q063L, A064S, S065T, K067N, E069V, V070I, D071Y, N072D, N073D, A074K, K076T, Q078S, R080Q, L081T, E083L |
| D_D0419091 | SEQ ID NO: 581 | G002A, T004S, S009A, I013V, S022T, G032A, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419093 | SEQ ID NO: 582 | G002A, I013V, S022T, G032A, S044L, L051V, Q063L, A064S, S065T, K067N, E069V, V070I, D071Y, N072D, N073D, A074K, K076T, Q078S, R080Q, L081T, I082L, E083L, L085A |
| D_D0419095 | SEQ ID NO: 583 | G002A, T004S, S009A, I013V, A016S, S022T, G032A, S044L, L049M, L051V, Q063L, A064S, S065T, K067N, E069V, V070I, D071Y, N072D, N073D, A074K, K076T, Q078S, R080Q, L081T, I082L, E083L |
| D_D0419096 | SEQ ID NO: 584 | G002A, T004S, S009A, S022T, G032A, T038S, S044L, L049M, L051V, K052Q, Q063L, A064S, S065T, K067N, E069V, V070I, D071Y, N072D, N073D, A074K, K076T, Q078S, R080Q, E083L, L085A |
| D_D0419098 | SEQ ID NO: 585 | G002A, T004S, S009A, I013V, A016S, S022T, G032A, E037D, T038S, S044L, L049M, L051V, K052Q, Q063L, A064S, S065T, K067N, E069V, V070I, D071Y, N072D, N073D, A074K, K076T, Q078S, R080Q |
| D_D0419099 | SEQ ID NO: 586 | G002A, T004S, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419101 | SEQ ID NO: 587 | G002A, T004S, S009A, S022T, G032A, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419102 | SEQ ID NO: 588 | G002A, T004S, N008S, S009A, I013V, S022T, G032A, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419106 | SEQ ID NO: 589 | G002A, T004S, S009A, A016S, S022T, G032A, S044L, L049M, L051V, K052Q, Q063L, A064S, S065T, K067N, E069V, V070I, D071Y, N072D, N073D, A074K, K076T, Q078S, R080Q, L081T, I082L |
| D_D0419108 | SEQ ID NO: 590 | G002A, T004S, S009A, I013V, S022T, G032A, E037D, T038S, S044L, L049M, L051V, Q063L, A064S, S065T, K067N, E069V, V070I, D071Y, N072D, N073D, A074K, K076T, Q078S, R080Q, L081T, E083L |
| D_D0419109 | SEQ ID NO: 591 | G002A, T004S, S009A, I013V, S022T, G032A, E037D, S044L, L049M, L051V, K052Q, Q063L, A064S, S065T, K067N, E069V, V070I, D071Y, N072D, N073D, A074K, K076T, Q078S, R080Q, L081T, I082F, E083V, L085V |
| D_D0419110 | SEQ ID NO: 592 | G002A, N008S, S009A, I013V, S022T, G032A, E037D, T038S, S044L, L049M, L051V, K052Q, Q063L, A064S, S065T, K067N, E069V, V070I, D071Y, N072D, N073D, A074K, K076T, Q078S, L081T, I082L, E083L |
| D_D0419111 | SEQ ID NO: 593 | G002A, T004S, S009A, I013V, S022T, G032A, E037D, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419114 | SEQ ID NO: 594 | G002A, T004S, N008S, I013V, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L, E083L |
| D_D0419115 | SEQ ID NO: 595 | G002A, T004S, S009A, S022T, G032A, E037D, T038S, S044L, L049M, L051V, Q063L, A064S, S065T, K067N, E069V, V070I, D071Y, N072D, N073D, A074K, K076T, Q078S, R080Q, L081T, I082L, E083L |
| D_D0419117 | SEQ ID NO: 596 | G002A, T004S, S009A, I013V, S022T, G032A, T038S, S044L, L049M, L051V, K052Q, Q063L, A064S, S065T, K067N, E069V, V070I, D071Y, N072D, N073D, A074K, K076T, Q078S, R080Q |
| D_D0419118 | SEQ ID NO: 597 | G002A, T004S, S009A, I013V, S022T, G032A, T038S, S044L, L051V, Q063L, A064S, S065T, K067N, E069V, V070I, D071Y, N072D, N073D, A074K, K076T, Q078S, R080Q |
| D_D0419119 | SEQ ID NO: 598 | G002A, S009A, I013V, A016S, S022T, G032A, T038S, S044L, L049M, L051V, K052Q, Q063L, A064S, S065T, K067N, E069V, V070I, D071Y, N072D, N073D, A074K, K076T, Q078S, R080Q, L081T, I082L, E083L, S086N |
| D_D0419120 | SEQ ID NO: 599 | G002A, N008S, S009A, I013V, S022T, G032A, E037D, T038S, S044L, L049M, L051V, Q063L, A064S, S065T, K067N, E069V, V070I, D071Y, N072D, N073D, A074K, K076T, Q078S, R080Q, L081T, I082L, E083L |
| D_D0419124 | SEQ ID NO: 600 | G002A, T004S, S009A, I013V, S022T, G032A, S044L, L051V, Q063L, A064S, S065T, K067N, E069V, V070I, D071Y, N072D, N073D, A074K, K076T, Q078S, R080Q, L081T, I082L, E083L |

TABLE 18-continued

| Clone Designation | Polypeptide | Amino acid substitutions compared to PIP-72Aa (SEQ ID NO: 2) |
|---|---|---|
| D_D0419126 | SEQ ID NO: 601 | G002A, T004S, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T |
| D_D0419127 | SEQ ID NO: 602 | G002A, T004S, S009A, I013V, S022T, G032A, E037D, S044L, L049M, L051V, Q063L, A064S, S065T, K067N, E069V, V070I, D071Y, N072D, N073D, A074K, K076T, Q078S, R080Q, I082L, E083L |
| D_D0419128 | SEQ ID NO: 603 | G002A, T004S, S009A, I013V, S022T, G032A, S044L, L049M, L051V, K052Q, Q063L, A064S, S065T, K067N, E069V, V070I, D071Y, N072D, N073D, A074K, K076T, Q078S, R080Q, L081T, E083L, S086N |
| D_D0419132 | SEQ ID NO: 604 | G002A, T004S, S009A, I013V, S022T, G032A, E037D, T038S, S044L, L049M, L051V, Q063L, A064S, S065T, K067N, E069V, V070I, D071Y, N072D, N073D, A074K, K076T, Q078S, R080Q, I082L |
| D_D0419138 | SEQ ID NO: 605 | G002A, T004S, S009A, I013V, A016S, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, I082L |
| D_D0419142 | SEQ ID NO: 606 | G002A, T004S, N008S, I013V, A016S, S022T, G032A, E037D, T038S, S044L, L049M, L051V, K052Q, Q063L, A064S, S065T, K067N, E069V, V070I, D071Y, N072D, N073D, A074K, K076T, Q078S, R080Q, L081T, I082L, E083L, L085A |
| D_D0419145 | SEQ ID NO: 607 | G002A, T004S, S009A, I013V, S022T, G032A, E037D, T038S, S044L, L051V, K052Q, Q063L, A064S, S065T, K067N, E069V, V070I, D071Y, N072D, N073D, A074K, K076T, Q078S, R080Q, L081T, I082L, E083L |

Example 9—PIP-72Aa Variants with Multiple Amino Acid Substitutions

To generate further PIP-72 polypeptide variants site-directed mutagenesis was performed using the oligonucleotide primers listed in Table 19 to introduce amino acid substitutions from PIP-72 Da (SEQ ID NO: 10) into PIP-72Aa (SEQ ID NO: 2) or from PIP-72Aa (SEQ ID NO: 2) into PIP-72 Da (SEQ ID NO: 845—resynthesized to facilitate mutagenesis). An amino acid sequence alignment of PIP-72Aa (SEQ ID NO: 2) and PIP-72 Da (SEQ ID NO: 10) is shown in FIG. 6. Synthetic gene fragments were subcloned in expression vector pCOLD™1 as described in Example 3.

TABLE 19

| Primer | Sequence identifier | Primer | Sequence identifier |
|---|---|---|---|
| 72_DG_1aF | SEQ ID NO: 171 | 72_DG_5aF-2 | SEQ ID NO: 181 |
| 72_DG_1bF | SEQ ID NO: 172 | 72_DG_5bF-2 | SEQ ID NO: 182 |
| 72_DG_1cF | SEQ ID NO: 173 | 72_DG_5cF-2 | SEQ ID NO: 183 |
| 72_DG_1dF | SEQ ID NO: 174 | 72_DG_5dF-2 | SEQ ID NO: 184 |
| 72_DG_2F | SEQ ID NO: 175 | 72c_Div_1F | SEQ ID NO: 185 |
| 72_DG_3aF | SEQ ID NO: 176 | 72c_Div_2F | SEQ ID NO: 186 |
| 72_DG_3bF | SEQ ID NO: 177 | 72c_Div_3F | SEQ ID NO: 187 |
| 72_DG_3cF | SEQ ID NO: 178 | 72c_Div_4F | SEQ ID NO: 188 |
| 72_DG_3dF | SEQ ID NO: 179 | 72c_Div_5F-2 | SEQ ID NO: 189 |
| 72_DG_4F | SEQ ID NO: 180 | | |

The resulting plasmid DNAs were transformed into *E. coli*, and the insecticidal protein was expressed as described in Example 3. Bioassays were performed on Western Corn Root Worm as described in Example 4 to determine which gene variants retained insecticidal activity. DNA sequencing was performed on the active gene variants. The percent identity compared to PIP-72Aa (SEQ ID NO: 2), clone designation, nucleotide and amino acid sequences of the resulting active PIP-72 polypeptide variants are listed in Table 20. Out of approximately 180 unique PIP-72 polypeptide variants that were screened, 156 active variants were identified. Table 21 summarizes the % identity of the active variants compared to PIP-72Aa (SEQ ID NO: 17), the number of clones with each % identity and the clone identification. Table 22 shows the amino acid substitutions of the resulting active PIP-72 polypeptide variants compared to PIP-72Aa (SEQ ID NO: 2).

TABLE 20

| % Identity to PIP-72Aa SEQ ID NO: 2 | Clone designations | Polynucleotide | Polypeptide |
|---|---|---|---|
| 86% | D_D0403719 | SEQ ID NO: 367 | SEQ ID NO: 608 |
| 86% | D_D0403734 | SEQ ID NO: 368 | SEQ ID NO: 609 |
| 86% | D_D0403823 | SEQ ID NO: 369 | SEQ ID NO: 610 |
| 86% | D_D0403844 | SEQ ID NO: 370 | SEQ ID NO: 611 |
| 86% | D_D0403865 | SEQ ID NO: 371 | SEQ ID NO: 612 |
| 86% | D_D0403897 | SEQ ID NO: 372 | SEQ ID NO: 613 |
| 86% | D_D0403907 | SEQ ID NO: 373 | SEQ ID NO: 614 |
| 95% | D_D0404048 | SEQ ID NO: 374 | SEQ ID NO: 615 |
| 98% | D_D0404051 | SEQ ID NO: 375 | SEQ ID NO: 616 |
| 96% | D_D0404052 | SEQ ID NO: 376 | SEQ ID NO: 617 |
| 98% | D_D0404054 | SEQ ID NO: 377 | SEQ ID NO: 618 |
| 95% | D_D0404056 | SEQ ID NO: 378 | SEQ ID NO: 619 |
| 98% | D_D0404057 | SEQ ID NO: 379 | SEQ ID NO: 620 |
| 96% | D_D0404062 | SEQ ID NO: 380 | SEQ ID NO: 621 |
| 95% | D_D0404066 | SEQ ID NO: 381 | SEQ ID NO: 622 |
| 96% | D_D0404067 | SEQ ID NO: 382 | SEQ ID NO: 623 |
| 95% | D_D0404068 | SEQ ID NO: 383 | SEQ ID NO: 624 |
| 95% | D_D0404073 | SEQ ID NO: 384 | SEQ ID NO: 625 |
| 98% | D_D0404074 | SEQ ID NO: 385 | SEQ ID NO: 626 |
| 95% | D_D0404078 | SEQ ID NO: 386 | SEQ ID NO: 627 |
| 88% | D_D0404079 | SEQ ID NO: 387 | SEQ ID NO: 628 |
| 98% | D_D0404098 | SEQ ID NO: 388 | SEQ ID NO: 629 |
| 92% | D_D0404103 | SEQ ID NO: 389 | SEQ ID NO: 630 |
| 98% | D_D0404111 | SEQ ID NO: 390 | SEQ ID NO: 631 |
| 99% | D_D0404113 | SEQ ID NO: 391 | SEQ ID NO: 632 |
| 99% | D_D0404116 | SEQ ID NO: 392 | SEQ ID NO: 633 |
| 98% | D_D0404119 | SEQ ID NO: 393 | SEQ ID NO: 634 |
| 96% | D_D0404120 | SEQ ID NO: 394 | SEQ ID NO: 635 |
| 96% | D_D0404121 | SEQ ID NO: 395 | SEQ ID NO: 636 |
| 96% | D_D0404122 | SEQ ID NO: 396 | SEQ ID NO: 637 |
| 96% | D_D0404128 | SEQ ID NO: 397 | SEQ ID NO: 638 |
| 98% | D_D0404130 | SEQ ID NO: 398 | SEQ ID NO: 639 |
| 95% | D_D0404135 | SEQ ID NO: 399 | SEQ ID NO: 640 |
| 91% | D_D0405129 | SEQ ID NO: 400 | SEQ ID NO: 641 |
| 92% | D_D0405130 | SEQ ID NO: 401 | SEQ ID NO: 642 |
| 94% | D_D0405132 | SEQ ID NO: 402 | SEQ ID NO: 643 |
| 95% | D_D0405135 | SEQ ID NO: 403 | SEQ ID NO: 644 |
| 90% | D_D0405137 | SEQ ID NO: 404 | SEQ ID NO: 645 |
| 94% | D_D0405139 | SEQ ID NO: 405 | SEQ ID NO: 646 |
| 87% | D_D0405141 | SEQ ID NO: 406 | SEQ ID NO: 647 |
| 85% | D_D0405142 | SEQ ID NO: 407 | SEQ ID NO: 648 |
| 92% | D_D0405145 | SEQ ID NO: 408 | SEQ ID NO: 649 |
| 99% | D_D0405148 | SEQ ID NO: 409 | SEQ ID NO: 650 |
| 98% | D_D0405151 | SEQ ID NO: 410 | SEQ ID NO: 651 |
| 98% | D_D0405153 | SEQ ID NO: 411 | SEQ ID NO: 652 |
| 98% | D_D0405157 | SEQ ID NO: 412 | SEQ ID NO: 653 |
| 96% | D_D0405159 | SEQ ID NO: 413 | SEQ ID NO: 654 |
| 99% | D_D0405163 | SEQ ID NO: 414 | SEQ ID NO: 655 |
| 87% | D_D0405169 | SEQ ID NO: 415 | SEQ ID NO: 656 |
| 99% | D_D0405174 | SEQ ID NO: 416 | SEQ ID NO: 657 |
| 90% | D_D0405177 | SEQ ID NO: 417 | SEQ ID NO: 658 |
| 93% | D_D0405183 | SEQ ID NO: 418 | SEQ ID NO: 659 |
| 88% | D_D0405187 | SEQ ID NO: 419 | SEQ ID NO: 660 |

TABLE 20-continued

| % Identity to PIP-72Aa SEQ ID NO: 2 | Clone designations | Polynucleotide | Polypeptide |
|---|---|---|---|
| 95% | D_D0405191 | SEQ ID NO: 420 | SEQ ID NO: 661 |
| 93% | D_D0405192 | SEQ ID NO: 421 | SEQ ID NO: 662 |
| 93% | D_D0405193 | SEQ ID NO: 422 | SEQ ID NO: 663 |
| 94% | D_D0405199 | SEQ ID NO: 423 | SEQ ID NO: 664 |
| 91% | D_D0405204 | SEQ ID NO: 424 | SEQ ID NO: 665 |
| 93% | D_D0405205 | SEQ ID NO: 425 | SEQ ID NO: 666 |
| 98% | D_D0405213 | SEQ ID NO: 426 | SEQ ID NO: 667 |
| 82% | D_D0405218 | SEQ ID NO: 427 | SEQ ID NO: 668 |
| 82% | D_D0405219 | SEQ ID NO: 428 | SEQ ID NO: 669 |
| 98% | D_D0405227 | SEQ ID NO: 429 | SEQ ID NO: 670 |
| 96% | D_D0405228 | SEQ ID NO: 430 | SEQ ID NO: 671 |
| 99% | D_D0405230 | SEQ ID NO: 431 | SEQ ID NO: 672 |
| 96% | D_D0405231 | SEQ ID NO: 432 | SEQ ID NO: 673 |
| 99% | D_D0405233 | SEQ ID NO: 433 | SEQ ID NO: 674 |
| 94% | D_D0405238 | SEQ ID NO: 434 | SEQ ID NO: 675 |
| 94% | D_D0405239 | SEQ ID NO: 435 | SEQ ID NO: 676 |
| 96% | D_D0405241 | SEQ ID NO: 436 | SEQ ID NO: 677 |
| 96% | D_D0405242 | SEQ ID NO: 437 | SEQ ID NO: 678 |
| 98% | D_D0405243 | SEQ ID NO: 438 | SEQ ID NO: 679 |
| 96% | D_D0405244 | SEQ ID NO: 439 | SEQ ID NO: 680 |
| 99% | D_D0405249 | SEQ ID NO: 440 | SEQ ID NO: 681 |
| 96% | D_D0405251 | SEQ ID NO: 441 | SEQ ID NO: 682 |
| 98% | D_D0405252 | SEQ ID NO: 442 | SEQ ID NO: 683 |
| 99% | D_D0405254 | SEQ ID NO: 443 | SEQ ID NO: 684 |
| 99% | D_D0405258 | SEQ ID NO: 444 | SEQ ID NO: 685 |
| 98% | D_D0405260 | SEQ ID NO: 445 | SEQ ID NO: 686 |
| 98% | D_D0405261 | SEQ ID NO: 446 | SEQ ID NO: 687 |
| 98% | D_D0405281 | SEQ ID NO: 447 | SEQ ID NO: 688 |
| 93% | D_D0405282 | SEQ ID NO: 448 | SEQ ID NO: 689 |
| 94% | D_D0405284 | SEQ ID NO: 449 | SEQ ID NO: 690 |
| 96% | D_D0405285 | SEQ ID NO: 450 | SEQ ID NO: 691 |
| 95% | D_D0405288 | SEQ ID NO: 451 | SEQ ID NO: 692 |
| 95% | D_D0405289 | SEQ ID NO: 452 | SEQ ID NO: 693 |
| 95% | D_D0405290 | SEQ ID NO: 453 | SEQ ID NO: 694 |
| 98% | D_D0405291 | SEQ ID NO: 454 | SEQ ID NO: 695 |
| 95% | D_D0405292 | SEQ ID NO: 455 | SEQ ID NO: 696 |
| 99% | D_D0405294 | SEQ ID NO: 456 | SEQ ID NO: 697 |
| 94% | D_D0405297 | SEQ ID NO: 457 | SEQ ID NO: 698 |
| 95% | D_D0405299 | SEQ ID NO: 458 | SEQ ID NO: 699 |
| 94% | D_D0405300 | SEQ ID NO: 459 | SEQ ID NO: 700 |
| 99% | D_D0405302 | SEQ ID NO: 460 | SEQ ID NO: 701 |
| 94% | D_D0405307 | SEQ ID NO: 461 | SEQ ID NO: 702 |
| 91% | D_D0405309 | SEQ ID NO: 462 | SEQ ID NO: 703 |
| 99% | D_D0405310 | SEQ ID NO: 463 | SEQ ID NO: 704 |
| 94% | D_D0405311 | SEQ ID NO: 464 | SEQ ID NO: 705 |
| 96% | D_D0405312 | SEQ ID NO: 465 | SEQ ID NO: 706 |
| 94% | D_D0405313 | SEQ ID NO: 466 | SEQ ID NO: 707 |
| 96% | D_D0405320 | SEQ ID NO: 467 | SEQ ID NO: 708 |
| 70% | D_D0408199 | SEQ ID NO: 468 | SEQ ID NO: 709 |
| 70% | D_D0408201 | SEQ ID NO: 469 | SEQ ID NO: 710 |
| 71% | D_D0408212 | SEQ ID NO: 470 | SEQ ID NO: 711 |
| 76% | D_D0408220 | SEQ ID NO: 471 | SEQ ID NO: 712 |
| 77% | D_D0408221 | SEQ ID NO: 472 | SEQ ID NO: 713 |
| 73% | D_D0408223 | SEQ ID NO: 473 | SEQ ID NO: 714 |
| 77% | D_D0408226 | SEQ ID NO: 474 | SEQ ID NO: 715 |
| 73% | D_D0408229 | SEQ ID NO: 475 | SEQ ID NO: 716 |
| 72% | D_D0408231 | SEQ ID NO: 476 | SEQ ID NO: 717 |
| 73% | D_D0408234 | SEQ ID NO: 477 | SEQ ID NO: 718 |
| 72% | D_D0408238 | SEQ ID NO: 478 | SEQ ID NO: 719 |
| 72% | D_D0408241 | SEQ ID NO: 479 | SEQ ID NO: 720 |
| 71% | D_D0408246 | SEQ ID NO: 480 | SEQ ID NO: 721 |
| 76% | D_D0408250 | SEQ ID NO: 481 | SEQ ID NO: 722 |
| 73% | D_D0408253 | SEQ ID NO: 482 | SEQ ID NO: 723 |
| 72% | D_D0408254 | SEQ ID NO: 483 | SEQ ID NO: 724 |
| 71% | D_D0408261 | SEQ ID NO: 484 | SEQ ID NO: 725 |
| 70% | D_D0408267 | SEQ ID NO: 485 | SEQ ID NO: 726 |
| 72% | D_D0408268 | SEQ ID NO: 486 | SEQ ID NO: 727 |
| 73% | D_D0408270 | SEQ ID NO: 487 | SEQ ID NO: 728 |
| 70% | D_D0408275 | SEQ ID NO: 488 | SEQ ID NO: 729 |
| 72% | D_D0408276 | SEQ ID NO: 489 | SEQ ID NO: 730 |
| 74% | D_D0408277 | SEQ ID NO: 490 | SEQ ID NO: 731 |
| 78% | D_D0408283 | SEQ ID NO: 491 | SEQ ID NO: 732 |
| 74% | D_D0408284 | SEQ ID NO: 492 | SEQ ID NO: 733 |
| 73% | D_D0408286 | SEQ ID NO: 493 | SEQ ID NO: 734 |
| 76% | D_D0408287 | SEQ ID NO: 494 | SEQ ID NO: 735 |
| 77% | D_D0408294 | SEQ ID NO: 495 | SEQ ID NO: 736 |
| 73% | D_D0408295 | SEQ ID NO: 496 | SEQ ID NO: 737 |
| 79% | D_D0408296 | SEQ ID NO: 497 | SEQ ID NO: 738 |
| 74% | D_D0408297 | SEQ ID NO: 498 | SEQ ID NO: 739 |
| 71% | D_D0408298 | SEQ ID NO: 499 | SEQ ID NO: 740 |
| 74% | D_D0408302 | SEQ ID NO: 500 | SEQ ID NO: 741 |
| 74% | D_D0408308 | SEQ ID NO: 501 | SEQ ID NO: 742 |
| 73% | D_D0408309 | SEQ ID NO: 502 | SEQ ID NO: 743 |
| 72% | D_D0408314 | SEQ ID NO: 503 | SEQ ID NO: 744 |
| 74% | D_D0408318 | SEQ ID NO: 504 | SEQ ID NO: 745 |
| 73% | D_D0408319 | SEQ ID NO: 505 | SEQ ID NO: 746 |
| 72% | D_D0408322 | SEQ ID NO: 506 | SEQ ID NO: 747 |
| 79% | D_D0408329 | SEQ ID NO: 507 | SEQ ID NO: 748 |
| 78% | D_D0408331 | SEQ ID NO: 508 | SEQ ID NO: 749 |
| 74% | D_D0408338 | SEQ ID NO: 509 | SEQ ID NO: 750 |
| 78% | D_D0408340 | SEQ ID NO: 510 | SEQ ID NO: 751 |
| 70% | D_D0408353 | SEQ ID NO: 511 | SEQ ID NO: 752 |
| 78% | D_D0408357 | SEQ ID NO: 512 | SEQ ID NO: 753 |
| 76% | D_D0408359 | SEQ ID NO: 513 | SEQ ID NO: 754 |
| 73% | D_D0408361 | SEQ ID NO: 514 | SEQ ID NO: 755 |
| 78% | D_D0408366 | SEQ ID NO: 515 | SEQ ID NO: 756 |
| 74% | D_D0408368 | SEQ ID NO: 516 | SEQ ID NO: 757 |
| 73% | D_D0408370 | SEQ ID NO: 517 | SEQ ID NO: 758 |
| 73% | D_D0408372 | SEQ ID NO: 518 | SEQ ID NO: 759 |
| 74% | D_D0408373 | SEQ ID NO: 519 | SEQ ID NO: 760 |
| 72% | D_D0408374 | SEQ ID NO: 520 | SEQ ID NO: 761 |
| 73% | D_D0408377 | SEQ ID NO: 521 | SEQ ID NO: 762 |
| 72% | D_D0408381 | SEQ ID NO: 522 | SEQ ID NO: 763 |
| 74% | D_D0408382 | SEQ ID NO: 523 | SEQ ID NO: 764 |
| 73% | D_D0408384 | SEQ ID NO: 524 | SEQ ID NO: 765 |
| 76% | D_D0408385 | SEQ ID NO: 525 | SEQ ID NO: 766 |
| 72% | D_D0408386 | SEQ ID NO: 526 | SEQ ID NO: 767 |
| 74% | D_D0408387 | SEQ ID NO: 527 | SEQ ID NO: 768 |
| 78% | D_D0348839 | SEQ ID NO: 770 | SEQ ID NO: 772 |
| 85% | D_D0347298 | SEQ ID NO: 769 | SEQ ID NO: 771 |

TABLE 21

| Identity to PIP-72Aa (%) | # of variants | Variants name |
|---|---|---|
| 46% | 1 | D_D0414430 |
| 48% | 4 | D_D0407437, D_D0414422, D_D0414454, D_D0414462 |
| 49% | 6 | D_D0414416, D_D0414425, D_D0414449, D_D0414450, D_D0414453, D_D0414471 |
| 50% | 7 | D_D0414424, D_D0414439, D_D0414459, D_D0414466, D_D0414479, D_D0414489, D_D0414493 |
| 51% | 4 | D_D0414433, D_D0414470, D_D0414475, D_D0414486 |
| 52% | 2 | D_D0414411, D_D0414455 |
| 53% | 4 | D_D0407429, D_D0414366, D_D0414412, D_D0414427 |
| 55% | 2 | D_D0414317, D_D0414355 |
| 56% | 2 | D_D0407455, D_D0414326 |
| 57% | 3 | D_D0407456, D_D0414327, D_D0414388 |
| 65% | 1 | D_D0419142 |
| 66% | 3 | D_D0419060, D_D0419066, D_D0419084 |
| 67% | 5 | D_D0407461, D_D0419109, D_D0419110, D_D0419114, D_D0419119 |
| 69% | 11 | D_D0419050, D_D0419057, D_D0419071, D_D0419075, D_d0419083, D_D0419091, D_D0419102, D_D0419111, D_D0419120, D_D0419138, D_D0419145 |
| 70% | 17 | D_D0419051, D_D0419053, D_D0419064, D_D0419072, D_D0419087, D_D0419095, D_D0419098, D_D0419099, D_D0419101, D_D0419108, D_D0419115, D_D0419128, D_D0408199, D_D0408201, D_D0408267, D_D0408275, D_D0408353 |
| 71% | 11 | D_D0419058, D_D0419062, D_D0419082, D_D0419096, D_D0419106, D_D0419127, D_D0419132, D_D0408212, D_D0408246, D_D0408261, D_D0408298 |

TABLE 21-continued

| Identity to PIP-72Aa (%) | # of variants | Variants name |
|---|---|---|
| 72% | 15 | D_D0419077, D_D0419117, D_D0419124, D_D0419126, D_D0408231, D_D0408238, D_D0408241, D_D0408254, D_D0408268, D_D0408276, D_D0408314, D_D0408322, D_D0408374, D_D0408381, D_D0408386 |
| 73% | 15 | D_D0419093, D_D0408223, D_D0408229, D_D0408234, D_D0408253, D_D0408270, D_D0408286, D_D0408295, D_D0408309, D_D0408319, D_D0408361, D_D0408370, D_D0408372, D_D0408377, D_D0408384 |
| 74% | 12 | D_D0419118, D_D0408277, D_D0408284, D_D0408297, D_D0408302, D_D0408308, D_D0408318, D_D0408338, D_D0408368, D_D0408373, D_D0408382, D_D0408387 |
| 76% | 5 | D_D0408220, D_D0408250, D_D0408287, D_D0408359, D_D0408385 |
| 77% | 3 | D_D0408221, D_D0408226, D_D0408294 |
| 78% | 6 | D_D0408283, D_D0408331, D_D0408340, D_D0408357, D_D0408366, D_D0348839 |
| 79% | 2 | D_D0408296, D_D0408329 |
| 82% | 2 | D_D0405218, D_D0405219 |
| 85% | 2 | D_D0405142, D_D0347298 |
| 86% | 7 | D_D0403719, D_D0403734, D_D0403823, D_D0403844, D_D0403865, D_D0403897, D_D0403907 |
| 87% | 2 | D_D0405141, D_D0405169 |
| 88% | 2 | D_D0404079, D_D0405187 |
| 90% | 2 | D_D0405137, D_D0405177 |
| 91% | 3 | D_D0405129, D_D0405204, D_D0405309 |
| 92% | 3 | D_D0404103, D_D0405130, D_D0405145 |
| 93% | 5 | D_D0405183, D_D0405192, D_D0405193, D_D0405205, D_D0405282 |
| 94% | 11 | D_D0405132, D_D0405139, D_D0405199, D_D0405238, D_D0405239, D_D0405284, D_D0405297, D_D0405300, D_D0405307, D_D0405311, D_D0405313 |
| 95% | 14 | D_D0404048, D_D0404056, D_D0404066, D_D0404068, D_D0404073, D_D0404078, D_D0404135, D_D0405135, D_D0405191, D_D0405288, D_D0405289, D_D0405290, D_D0405292, D_D0405299 |
| 96% | 17 | D_D0404052, D_D0404062, D_D0404067, D_D0404120, D_D0404121, D_D0404122, D_D0404128, D_D0405159, D_D0405228, D_D0405231, D_D0405241, D_D0405242, D_D0405244, D_D0405251, D_D0405285, D_D0405312, D_D0405320 |
| 98% | 19 | D_D0404051, D_D0404054, D_D0404057, D_D0404074, D_D0404098, D_D0404111, D_D0404119, D_D0404130, D_D0405151, D_D0405153, D_D0405157, D_D0405213, D_D0405227, D_D0405243, D_D0405252, D_D0405260, D_D0405261, D_D0405281, D_D0405291 |
| 99% | 13 | D_D0404113, D_D0404116, D_D0405148, D_D0405163, D_D0405174, D_D0405230, D_D0405233, D_D0405249, D_D0405254, D_D0405258, D_D0405294, D_D0405302, D_D0405310 |

TABLE 22

| Clone Designation | Polypeptide | Amino Acid Substitutions compared to PIP-72Aa (SEQ ID NO: 2) |
|---|---|---|
| D_D0403719 | SEQ ID NO: 608 | N011G, S027Q, S030P, N033S, T038S, S044D, K053N, D071E, A074Y, Q078S, R080D, E083L |
| D_D0403734 | SEQ ID NO: 609 | N011G, P012D, S027Q, S030K, G032A, N033P, T038S, S044A, K053N, D071E, R080D, E083L |
| D_D0403823 | SEQ ID NO: 610 | N011G, P012D, S030K, G032A, N033P, S044D, K053N, D071E, N073D, A074T, R080D, E083L |
| D_D0403844 | SEQ ID NO: 611 | S009L, P012D, S027Q, S030K, N033P, T038S, S044A, D071E, N073D, Q078S, R080E, E083L |
| D_D0403865 | SEQ ID NO: 612 | N008S, N011G, P012D, S030K, N033S, T038S, S044D, K053N, D071E, A074Y, Q078S, R080E |
| D_D0403897 | SEQ ID NO: 613 | N011G, S027Q, S030K, G032A, N033P, T038S, S044D, K053N, D071E, N073D, Q078S, R080E |
| D_D0403907 | SEQ ID NO: 614 | N008S, N011G, P012D, S027Q, S030K, N033S, S044D, K053N, D071E, N073D, Q078S, R080Q |

TABLE 22-continued

| Clone Designation | Polypeptide | Amino Acid Substitutions compared to PIP-72Aa (SEQ ID NO: 2) |
|---|---|---|
| D_D0404048 | SEQ ID NO: 615 | N011K, V015A, K053R, H058A |
| D_D0404051 | SEQ ID NO: 616 | T038S, K053R |
| D_D0404052 | SEQ ID NO: 617 | N011K, R080Q, E083Q |
| D_D0404054 | SEQ ID NO: 618 | N011K, T038S |
| D_D0404056 | SEQ ID NO: 619 | V015A, H019K, K053R, H058A |
| D_D0404057 | SEQ ID NO: 620 | N011K, A074T |
| D_D0404062 | SEQ ID NO: 621 | K053R, E083H, L085V |
| D_D0404066 | SEQ ID NO: 622 | K053R, H058A, E083H, L085V |
| D_D0404067 | SEQ ID NO: 623 | N011K, V015A, K053R |
| D_D0404068 | SEQ ID NO: 624 | N033S, K053R, A074T, R080E |
| D_D0404073 | SEQ ID NO: 625 | T038S, K053R, H058A, L085V |
| D_D0404074 | SEQ ID NO: 626 | K053R, E083H |
| D_D0404078 | SEQ ID NO: 627 | N011K, P012K, H019K, H058A |
| D_D0404079 | SEQ ID NO: 628 | N011K, S030G, G032D, T038S, K053R, S065T, D071E, A074T, L085V, S086A |
| D_D0404098 | SEQ ID NO: 629 | S065T, V070I |
| D_D0404103 | SEQ ID NO: 630 | V015A, H019K, V031I, G032D, N033S, T038S, K053R |
| D_D0404111 | SEQ ID NO: 631 | T038S, K053R |
| D_D0404113 | SEQ ID NO: 632 | K053N |
| D_D0404116 | SEQ ID NO: 633 | E083H |
| D_D0404119 | SEQ ID NO: 634 | P012K, H019K |
| D_D0404120 | SEQ ID NO: 635 | S030G, N033S, T038S |
| D_D0404121 | SEQ ID NO: 636 | H058A, R080E, L085V |
| D_D0404122 | SEQ ID NO: 637 | E083H, L085V, S086A |
| D_D0404128 | SEQ ID NO: 638 | N011K, V015A, E083H |
| D_D0404130 | SEQ ID NO: 639 | N011K, H019K |
| D_D0404135 | SEQ ID NO: 640 | S030G, V031I, N033S, T038S |
| D_D0405129 | SEQ ID NO: 641 | N011K, P012K, V015A, H019K, S065T, V070I, D071E, A074T |
| D_D0405130 | SEQ ID NO: 642 | H019K, K053R, H058A, S065T, V070I, D071E, A074T |
| D_D0405132 | SEQ ID NO: 643 | S030G, V031I, G032D, N033S, T038S |
| D_D0405135 | SEQ ID NO: 644 | N011K, P012K, V015A, H019K |
| D_D0405137 | SEQ ID NO: 645 | N011K, P012K, V015A, H019K, S030G, V031I, G032D, N033S, T038S |
| D_D0405139 | SEQ ID NO: 646 | N011K, P012K, V015A, H019K, K053S |
| D_D0405141 | SEQ ID NO: 647 | N011K, P012K, V015A, H019K, T038S, K053R, H058A, S065T, V070I, D071E, A074T |
| D_D0405142 | SEQ ID NO: 648 | N011K, P012K, V015A, H019K, S030G, V031I, G032D, N033S, T038S, S065T, V070I, D071E, A074T |
| D_D0405145 | SEQ ID NO: 649 | S030G, V031I, G032D, N033S, T038S, K053R, H058A |
| D_D0405148 | SEQ ID NO: 650 | T038S |
| D_D0405151 | SEQ ID NO: 651 | V015A, H019K |
| D_D0405153 | SEQ ID NO: 652 | K053R, H058A |

TABLE 22-continued

| Clone Designation | Polypeptide | Amino Acid Substitutions compared to PIP-72Aa (SEQ ID NO: 2) |
|---|---|---|
| D_D0405157 | SEQ ID NO: 653 | T038S, H058A |
| D_D0405159 | SEQ ID NO: 654 | K053R, H058A, A074T |
| D_D0405163 | SEQ ID NO: 655 | K053R |
| D_D0405169 | SEQ ID NO: 656 | N011K, P012K, V015A, H019K, S030G, V031I, G032D, N033S, T038S, K053R, H058A |
| D_D0405174 | SEQ ID NO: 657 | H058A |
| D_D0405177 | SEQ ID NO: 658 | S030G, V031I, G032D, N033S, T038S, S065T, V070I, D071E, A074T |
| D_D0405183 | SEQ ID NO: 659 | N011K, P012K, V015A, H019K, T038S, H058A |
| D_D0405187 | SEQ ID NO: 660 | N011K, P012K, V015A, H019K, S030G, V031I, G032D, N033S, K053R, H058A |
| D_D0405191 | SEQ ID NO: 661 | S065T, V070I, D071E, A074T |
| D_D0405192 | SEQ ID NO: 662 | K053R, H058A, S065T, V070I, D071E, A074T |
| D_D0405193 | SEQ ID NO: 663 | N011K, P012K, V015A, H019K, N033S, T038S |
| D_D0405199 | SEQ ID NO: 664 | K053R, H058A, V070I, D071E, A074T |
| D_D0405204 | SEQ ID NO: 665 | S030G, V031I, G032D, N033S, T038S, K053R, H058A, A074T |
| D_D0405205 | SEQ ID NO: 666 | N011K, P012K, V015A, H019K, K053R, H058A |
| D_D0405213 | SEQ ID NO: 667 | K053S, H058A |
| D_D0405218 | SEQ ID NO: 668 | N011K, P012K, V015A, H019K, S030G, V031I, G032D, N033S, T038S, K053R, H058A, R080E, E083H, L085V, S086A |
| D_D0405219 | SEQ ID NO: 669 | N011K, P012K, V015A, H019K, S030G, V031I, G032D, N033S, T038S, K053R, H058A, S065T, V070I, D071E, A074T |
| D_D0405227 | SEQ ID NO: 670 | R080E, S086A |
| D_D0405228 | SEQ ID NO: 671 | N011K, V015A, L085V |
| D_D0405230 | SEQ ID NO: 672 | H019K |
| D_D0405231 | SEQ ID NO: 673 | N011K, E083H, L085V |
| D_D0405233 | SEQ ID NO: 674 | N011K |
| D_D0405238 | SEQ ID NO: 675 | N011K, V015A, E083H, L085V, S086A |
| D_D0405239 | SEQ ID NO: 676 | N011K, H058A, R080E, L085V, S086A |
| D_D0405241 | SEQ ID NO: 677 | N011K, P012K, V015A |
| D_D0405242 | SEQ ID NO: 678 | N011K, R080E, S086A |
| D_D0405243 | SEQ ID NO: 679 | N011K, V015A |
| D_D0405244 | SEQ ID NO: 680 | N011K, V015A, H019K |
| D_D0405249 | SEQ ID NO: 681 | P012K |
| D_D0405251 | SEQ ID NO: 682 | P012K, V015A, H019K |
| D_D0405252 | SEQ ID NO: 683 | P012K, V015A |
| D_D0405254 | SEQ ID NO: 684 | V015A |
| D_D0405258 | SEQ ID NO: 685 | R080E |
| D_D0405260 | SEQ ID NO: 686 | H019K, K053R |
| D_D0405261 | SEQ ID NO: 687 | E083H, L085V |
| D_D0405281 | SEQ ID NO: 688 | N033S, T038S |
| D_D0405282 | SEQ ID NO: 689 | S030G, V031I, G032D, N033S, T038S, K053R |
| D_D0405284 | SEQ ID NO: 690 | V031I, G032D, T038S, R080E, L085V |
| D_D0405285 | SEQ ID NO: 691 | K053R, R080E, S086A |
| D_D0405288 | SEQ ID NO: 692 | S030G, N033S, R080E, S086A |
| D_D0405289 | SEQ ID NO: 693 | G032D, K053R, R080E, E083H |
| D_D0405290 | SEQ ID NO: 694 | S030G, V031I, G032D, N033S |
| D_D0405291 | SEQ ID NO: 695 | S030G, K053R |
| D_D0405292 | SEQ ID NO: 696 | N033S, K053R, R080E, S086A |
| D_D0405294 | SEQ ID NO: 697 | S030G |
| D_D0405297 | SEQ ID NO: 698 | S030G, V031I, G032D, N033S, K053R |
| D_D0405299 | SEQ ID NO: 699 | K053H, H058P, E083H, S086A |
| D_D0405300 | SEQ ID NO: 700 | G032D, N033S, T038S, L085V, S086A |
| D_D0405302 | SEQ ID NO: 701 | N033S |
| D_D0405307 | SEQ ID NO: 702 | N033S, T038S, K053R, H058A, R080E |
| D_D0405309 | SEQ ID NO: 703 | S030G, V031I, N033S, T038S, K053R, H058A, R080E, L085V |
| D_D0405310 | SEQ ID NO: 704 | G032D |
| D_D0405311 | SEQ ID NO: 705 | S030G, G032D, N033S, L085V, S086A |
| D_D0405312 | SEQ ID NO: 706 | S030G, V031I, T038S |
| D_D0405313 | SEQ ID NO: 707 | S030G, G032D, N033S, T038S, H058A |
| D_D0405320 | SEQ ID NO: 708 | S030G, N033S, H058A |
| D_D0408199 | SEQ ID NO: 709 | N008K, N011K, P012K, V015A, A016S, H019K, S027K, S030G, V031I, G032D, N033S, T038S, S044D, K053R, H058A, S065T, V070I, D071E, N073S, A074T, Q078H, R080E, L081T, E083H, L085V, S086A |
| D_D0408201 | SEQ ID NO: 710 | N008K, N011K, P012K, V015A, A016S, H019K, S027K, S030G, V031I, G032D, N033S, T038S, S044D, A056T, H058A, S065T, V070I, D071E, N073S, A074T, Q078H, R080E, L081T, E083H, L085V, S086A |
| D_D0408212 | SEQ ID NO: 711 | N008K, N011K, P012K, V015A, A016S, H019K, S027K, S030G, V031I, G032D, N033S, T038S, S044D, H058A, S065T, V070I, D071E, N073S, A074T, Q078H, R080E, L081T, E083H, L085V, S086A |
| D_D0408220 | SEQ ID NO: 712 | N008K, N011K, P012K, V015A, A016S, H019K, S027K, S030G, V031I, G032D, N033S, T038S, S044D, H058A, S065T, V070I, D071E, N073S, A074T, E083H, L085V |
| D_D0408221 | SEQ ID NO: 713 | N011K, V015A, S027K, S030G, V031I, G032D, N033S, T038S, S044D, S065T, V070I, D071E, N073S, A074T, Q078H, R080E, L081T, E083H, L085V, S086A |
| D_D0408223 | SEQ ID NO: 714 | N011K, V015A, H019K, S027K, S030G, V031I, G032D, N033S, T038S, S044D, K053R, H058A, S065T, V070I, D071E, N073S, A074T, Q078H, R080E, L081T, E083H, L085V, S086A |
| D_D0408226 | SEQ ID NO: 715 | N011K, V015A, H019K, S027K, S030G, V031I, G032D, N033S, T038S, S044D, K053R, H058A, S065T, V070I, D071E, N073S, A074T, R080E, E083H, L085V |
| D_D0408229 | SEQ ID NO: 716 | N008K, N011K, P012K, V015A, A016S, H019K, S027K, S030G, V031I, G032D, N033S, T038S, S044D, K053R, S065T, V070I, D071E, N073S, A074T, Q078H, R080E, L085V, S086A |
| D_D0408231 | SEQ ID NO: 717 | N008K, N011K, P012K, V015A, A016S, H019K, S027K, S030G, V031I, G032D, N033S, T038S, S044D, S065T, V070I, D071E, N073S, A074T, Q078H, R080E, L081T, E083H, L085V, S086A |

TABLE 22-continued

| Clone Designation | Polypeptide | Amino Acid Substitutions compared to PIP-72Aa (SEQ ID NO: 2) |
|---|---|---|
| D_D0408234 | SEQ ID NO: 718 | N008K, N011K, P012K, V015A, A016S, H019K, S027K, S030G, V031I, G032D, N033S, T038S, S044D, K053R, A056T, H058A, S065T, V070I, D071E, N073S, A074T, R080E, S086A |
| D_D0408238 | SEQ ID NO: 719 | P012K, V015A, H019K, S027K, S030G, V031I, G032D, N033S, T038S, S044D, K053R, A056T, H058A, S065T, V070I, D071E, N073S, A074T, Q078H, R080E, L081T, E083H, L085V, S086A |
| D_D0408241 | SEQ ID NO: 720 | N008K, N011K, P012K, V015A, A016S, H019K, S027K, S030G, V031I, G032D, N033S, T038S, S044D, K053R, H058A, S065T, V070I, D071E, N073S, A074T, R080E, E083H, L085V, S086A |
| D_D0408246 | SEQ ID NO: 721 | N008K, N011K, P012K, V015A, A016S, H019K, S022R, S027K, S030G, V031I, G032D, N033S, T038S, S044D, K053R, A056T, H058A, S065T, V070I, D071E, N073S, A074T, E083H, L085V, S086A |
| D_D0408250 | SEQ ID NO: 722 | N008K, N011K, P012K, V015A, A016S, H019K, V031I, N033S, S044D, K053R, S065T, V070I, D071E, N073S, A074T, Q078H, R080E, L081T, E083H, L085V, S086A |
| D_D0408253 | SEQ ID NO: 723 | N008K, N011K, P012K, V015A, A016S, H019K, S030G, N033S, S044D, K053R, A056T, H058A, S065T, V070I, D071E, N073S, A074T, Q078H, R080E, L081T, E083H, L085V, S086A |
| D_D0408254 | SEQ ID NO: 724 | N008K, N011K, P012K, V015A, A016S, H019K, S030G, G032D, N033S, S044D, K053R, A056T, H058A, S065T, V070I, D071E, N073S, A074T, Q078H, R080E, L081T, E083H, L085V, S086A |
| D_D0408261 | SEQ ID NO: 725 | N008K, N011K, P012K, V015A, A016S, H019K, S030G, G032D, N033S, T038S, S044D, K053R, A056T, H058A, S065T, V070I, D071E, N073S, A074T, Q078H, R080E, L081T, E083H, L085V, S086A |
| D_D0408267 | SEQ ID NO: 726 | N008K, N011K, P012K, V015A, A016S, H019K, S027K, S030G, V031I, G032D, N033S, T038S, K053R, A056T, H058A, S065T, V070I, D071E, N0735, A074T, Q078H, R080E, L081T, E083H, L085V, S086A |
| D_D0408268 | SEQ ID NO: 727 | N008K, N011K, P012K, V015A, A016S, H019K, S030G, N033S, T038S, S044D, K053R, A056T, H058A, S065T, V070I, D071E, N073S, A074T, Q078H, R080E, L081T, E083H, L085V, S086A |
| D_D0408270 | SEQ ID NO: 728 | N008K, N011K, P012K, V015A, A016S, H019K, V031I, G032D, N033S, S044D, K053R, S065T, S066N, V070I, D071E, N073S, A074T, Q078H, R080E, L081T, E083H, L085V, S086A |
| D_D0408275 | SEQ ID NO: 729 | N008K, N011K, P012K, V015A, A016S, H019K, S027K, S030G, V031I, G032D, N033S, S044D, K053R, A056T, H058A, S065T, V070I, D071E, N073S, A074T, R080E, L081T, E083H, L085V, S086A |
| D_D0408276 | SEQ ID NO: 730 | N008K, N011K, P012K, V015A, A016S, H019K, S027K, S030G, V031I, G032D, N033S, K053R, H058A, S065T, V070I, D071E, N073S, A074T, Q078H, R080E, L081T, E083H, L085V, S086A |
| D_D0408277 | SEQ ID NO: 731 | N008K, N011K, P012K, V015A, A016S, H019K, S027K, S030G, V031I, G032D, N033S, S044D, K053R, H058A, S065T, V070I, D071E, N073S, A074T, R080E, E083H, L085V |
| D_D0408283 | SEQ ID NO: 732 | N008K, N011K, P012K, V015A, A016S, H019K, S027K, S030G, N033S, S044D, K053R, A056T, H058A, S065T, V070I, D071E, N073S, A074T, R080E |
| D_D0408284 | SEQ ID NO: 733 | N008K, N011K, P012K, V015A, A016S, H019K, S030G, G032D, N033S, S044D, K053R, S065T, V070I, D071E, N073S, A074T, Q078H, R080E, L081T, E083H, L085V, S086A |
| D_D0408286 | SEQ ID NO: 734 | N008K, N011K, P012K, V015A, A016S, H019K, S027K, S030G, V031I, G032D, N033S, T038S, S044D, K053R, S065T, V070I, D071E, N073S, A074T, R080E, E083H, L085V, S086A |
| D_D0408287 | SEQ ID NO: 735 | N008K, N011K, P012K, V015A, A016S, H019K, N033S, S044D, K053R, H058A, S065T, V070I, D071E, N073S, A074T, Q078H, R080E, L081T, E083H, L085V, S086A |
| D_D0408294 | SEQ ID NO: 736 | H019K, S027K, S030G, V031I, G032D, N033S, T038S, S044D, K053R, S065T, V070I, D071E, N073S, A074T, Q078H, R080E, L081T, E083H, L085V, S086A |
| D_D0408295 | SEQ ID NO: 737 | P012K, V015A, H019K, S027K, S030G, V031I, G032D, N033S, T038S, S044D, K053R, H058A, S065T, V070I, D071E, N073S, A074T, Q078H, R080E, L081T, E083H, L085V, S086A |
| D_D0408296 | SEQ ID NO: 738 | H019K, S027K, S030G, V031I, G032D, N033S, T038S, S044D, K053R, A056T, H058A, V070I, D071E, R080E, L081T, E083H, L085V, S086A |
| D_D0408297 | SEQ ID NO: 739 | N008K, N011K, P012K, V015A, A016S, H019K, S027K, S030G, V031I, G032D, N033S, T038S, S044D, H058A, S065T, V070I, D071E, N073S, A074T, R080E, E083H, S086A |
| D_D0408298 | SEQ ID NO: 740 | N008K, N011K, P012K, V015A, A016S, H019K, S027K, S030G, V031I, G032D, N033S, T038S, S044D, K053R, S065T, V070I, D071E, N073S, A074T, Q078H, R080E, L081T, E083H, S086A |
| D_D0408302 | SEQ ID NO: 741 | N011K, P012K, V015A, H019K, S027K, S030G, V031I, G032D, N033S, T038S, S044D, K053R, S065T, V070I, D071E, N073S, A074T, Q078H, R080E, L081T, E083H, L085V, S086A |
| D_D0408308 | SEQ ID NO: 742 | N011K, V015A, S027K, S030G, V031I, G032D, N033S, T038S, S044D, K053R, H058A, S065T, V070I, D071E, N073S, A074T, Q078H, R080E, L081T, E083H, L085V, S086A |
| D_D0408309 | SEQ ID NO: 743 | N011K, V015A, S027K, S030G, V031I, G032D, N033S, T038S, S044D, K053R, A056T, H058A, S065T, V070I, D071E, N073S, A074T, Q078H, R080E, L081T, E083H, L085V, S086A |
| D_D0408314 | SEQ ID NO: 744 | N008K, N011K, P012K, V015A, A016S, H019K, S030G, V031I, G032D, N033S, T038S, S044D, H058A, S065T, V070I, D071E, N073S, A074T, Q078H, R080E, L081T, E083H, L085V, S086A |
| D_D0408318 | SEQ ID NO: 745 | N008K, N011K, P012K, V015A, A016S, H019K, S027K, S030G, V031I, G032D, N033S, T038S, S044D, K053R, S065T, D071E, Q078H, R080E, L081T, E083H, L085V, S086A |
| D_D0408319 | SEQ ID NO: 746 | N008K, N011K, P012K, V015A, A016S, H019K, S027K, S030G, V031I, G032D, N033S, T038S, S044D, K053R, S065T, V070I, A074T, Q078H, R080E, L081T, E083H, L085V, S086A |
| D_D0408322 | SEQ ID NO: 747 | N011K, P012K, V015A, S027K, S030G, V031I, G032D, N033S, T038S, S044D, K053R, A056T, H058A, S065T, V070I, D071E, N073S, A074T, Q078H, R080E, L081T, E083H, L085V, S086A |
| D_D0408329 | SEQ ID NO: 748 | N011K, V015A, H019K, S027K, S030G, V031I, G032D, N033S, T038S, S044D, K053R, H058A, S065T, V070I, D071E, N073S, A074T, E083H |
| D_D0408331 | SEQ ID NO: 749 | N011K, V015A, H019K, G032D, N033S, S044D, K053R, H058A, S065T, V070I, D071E, N073S, A074T, Q078H, R080E, L081T, E083H, L085V, S086A |
| D_D0408338 | SEQ ID NO: 750 | N008K, N011K, P012K, V015A, H019K, S030G, N033S, S044D, K053R, A056T, H058A, S065T, V070I, D071E, N073S, A074T, Q078H, R080E, L081T, E083H, L085V, S086A |
| D_D0408340 | SEQ ID NO: 751 | H019K, S027K, S030G, V031I, N033S, T038S, S044D, K053R, S065T, V070I, D071E, N073S, A074T, Q078H, R080E, L081T, E083H, L085V, S086A |
| D_D0408353 | SEQ ID NO: 752 | N008K, N011K, P012K, V015A, A016S, H019K, S027K, S030G, V031I, G032D, N033S, T038S, S044D, K053S, H058A, S065T, V070I, D071E, N073S, A074T, Q078H, R080E, L081T, E083H, L085V, S086A |
| D_D0408357 | SEQ ID NO: 753 | N008K, N011K, P012K, V015A, A016S, H019K, S030G, N033S, S044D, S065T, V070I, D071E, N073S, A074T, R080E, L081T, E083H, L085V, S086A |
| D_D0408359 | SEQ ID NO: 754 | N008K, N011K, P012K, V015A, H019K, S027K, S030G, V031I, G032D, N033S, T038S, S044D, V070I, D071E, A074T, Q078H, R080E, L081T, E083H, L085V, S086A |

TABLE 22-continued

| Clone Designation | Polypeptide | Amino Acid Substitutions compared to PIP-72Aa (SEQ ID NO: 2) |
|---|---|---|
| D_D0408361 | SEQ ID NO: 755 | N008K, N011K, P012K, V015A, A016S, S030G, V031I, G032D, N033S, T038S, S044D, K053R, S065T, V070I, D071E, N073S, A074T, Q078H, R080E, L081T, E083H, L085V, S086A |
| D_D0408366 | SEQ ID NO: 756 | N008K, N011K, P012K, V015A, A016S, H019K, S027K, S030G, V031I, G032D, N033S, T038S, S044D, K053R, S065T, V070I, D071E, L085V, S086A |
| D_D0408368 | SEQ ID NO: 757 | N011K, S027K, S030G, V031I, G032D, N033S, T038S, S044D, K053R, A056T, H058A, S065T, V070I, D071E, N073S, A074T, Q078H, R080E, L081T, E083H, L085V, S086A |
| D_D0408370 | SEQ ID NO: 758 | N008K, N011K, P012K, V015A, H019K, S027K, S030G, V031I, G032D, N033S, T038S, S044D, S065T, V070I, D071E, N073S, A074T, Q078H, R080E, L081T, E083H, L085V, S086A |
| D_D0408372 | SEQ ID NO: 759 | N011K, V015A, H019K, S027K, S030G, V031I, G032D, N033S, T038S, S044D, K053R, H058A, S065T, V070I, D071E, N073S, A074T, Q078H, R080E, L081T, E083H, L085V, S086A |
| D_D0408373 | SEQ ID NO: 760 | N008K, N011K, P012K, V015A, H019K, S027K, S030G, V031I, G032D, N033S, T038S, S044D, K053R, S065T, V070I, D071E, N073S, A074T, R080E, E083H, L085V |
| D_D0408374 | SEQ ID NO: 761 | N008K, N011K, P012K, V015A, A016S, H019K, S027K, S030G, V031I, G032D, N033S, S044D, K053R, S065T, V070I, D071E, N073S, A074T, Q078H, R080E, L081T, E083H, L085V, S086A |
| D_D0408377 | SEQ ID NO: 762 | N011K, P012K, S027K, S030G, V031I, G032D, N033S, T038S, S044D, K053R, A056T, H058A, S065T, V070I, D071E, N073S, A074T, Q078H, R080E, L081T, E083H, L085V, S086A |
| D_D0408381 | SEQ ID NO: 763 | N008K, N011K, P012K, V015A, A016S, H019K, S027K, S030G, V031I, G032D, N033S, T038S, S044D, S065T, V070I, D071E, N073S, A074T, Q078H, R080E, L081T, E083H, L085V, S086A |
| D_D0408382 | SEQ ID NO: 764 | N011K, P012K, H019K, S027K, S030G, V031I, G032D, N033S, T038S, S044D, K053R, S065T, V070I, D071E, N073S, A074T, Q078H, R080E, L081T, E083H, L085V, S086A |
| D_D0408384 | SEQ ID NO: 765 | N008K, N011K, P012K, V015A, A016S, S027K, S030G, V031I, G032D, N033S, T038S, S044D, S065T, V070I, D071E, N073S, A074T, Q078H, R080E, L081T, E083H, L085V, S086A |
| D_D0408385 | SEQ ID NO: 766 | N011K, P012K, H019K, S027K, S030G, V031I, G032D, N033S, T038S, S044D, S065T, V070I, D071E, N073S, A074T, Q078H, R080E, L081T, E083H, L085V, S086A |
| D_D0408386 | SEQ ID NO: 767 | N008K, N011K, P012K, V015A, A016S, H019K, S027K, S030G, V031I, G032D, N033S, S044D, H058A, S065T, V070I, D071E, N073S, A074T, Q078H, R080E, L081T, E083H, L085V, S086A |
| D_D0408387 | SEQ ID NO: 768 | N008K, N011K, P012K, S027K, S030G, V031I, G032D, N033S, T038S, S044D, K053R, S065T, V070I, D071E, N073S, A074T, Q078H, R080E, L081T, E083H, L085V, S086A |
| D_D0348839 | SEQ ID NO: 772 | N008K, N011K, P012K, V015A, A016S, H019K, S027K, S030G, V031I, G032D, N033S, T038S, S044D, Q078H, R080E, L081T, E083H, L085V, S086A |
| D_D0347298 | SEQ ID NO: 771 | N008K, N011K, P012K, V015A, A016S, H019K, S027K, S030G, V031I, G032D, N033S, T038S, S044D |

Example 10—Identification of Amino Acid Positions Affecting the Function of PIP-72Aa The protein sequence alignment of PIP-72Aa (SEQ ID NO: 2) and other active family members PIP-72 Da (SEQ ID NO: 10), PIP-72Fa (SEQ ID NO: 18), GBP_A3175 (SEQ ID NO: 20) and PIP-72Gb (SEQ ID NO: 32) is shown in FIG. 2. From the alignment, conserved amino acid positions 7, 10, 20, 23, 24, 34, 60, 61, 66, 68, 75, 77, 79, 84 were selected for saturation mutagenesis using the oligonucleotide primers indicated in Table 23 (QuikChange™ technique, Agilent, 5301 Stevens Creek Blvd, Santa Clara Calif.). In addition, positions 8, 11, 12, 15, 16, 19, 27, 30, 31, 32, 33, 53, 56, 58, 65, 70, 71, 73, 74, 78, 80, 81, 83, 85, 86, which differ between PIP-72Aa (SEQ ID NO: 2) and PIP-72 Da (SEQ ID NO: 10) were subjected to saturation mutagenesis using a modification of the QuikChange™ method with Phusion® High Fidelity DNA Polymerase (New England Biolabs®, Cat #M0530L, 240 County Road, Ipswich, Mass. 01938-2723), with the oligonucleotide primers indicated in Table 23. The resulting plasmid DNAs were transformed into *E. coli*, and protein was expressed as described in Example 3. Bioassays were performed on Western Corn Root Worm as described in Example 4 to determine which gene variants retained insecticidal activity. Table 23 lists the positions that were addressed and summarizes the data that was obtained. The amino acid substitutions that were identified by DNA sequence analysis are shown. For each position, the amino acid substitutions which yielded PIP-72Aa variants that retained Western Corn Root Worm activity are shown.

TABLE 23

| Position | Oligo Name | Oligo sequence identifier | Identified Substitutions | Active Substitutions |
|---|---|---|---|---|
| N7 | NNK7_F | SEQ ID NO: 190 | A, V, C, E, F, G, H, I, | A, V |
|  | MNN7_R | SEQ ID NO: 191 | K, L, M, P, Q, R, S, T, W, Y |  |
| N8 | N8N_F | SEQ ID NO: 192 | A, C, D, E, G, H, I, K, | A, C, D, E, G, H, I, K, |
|  | N8N_R | SEQ ID NO: 193 | L, M, Q, R, S, T, V, F P, W, Y | L, M, Q, R, S, T, V |
| S10 | NNK10_F | SEQ ID NO: 194 | A, E, F, G, H, I, K, L, | A, E, F, G, H, I, K, L, |
|  | MNN10_R | SEQ ID NO: 195 | N, P, Q, R, T, W | N, P, Q, R, T, W |
| N11 | N11N_F | SEQ ID NO: 196 | A, C, D, E, G, H, I, K, | A, C, D, E, G, H, I, K, |
|  | N11N_R | SEQ ID NO: 197 | L, M, Q, S, T, V, Y, P, R, W | M, Q, S, T, V, Y |
| P12 | P12N_F | SEQ ID NO: 198 | A, C, D, E, G, H, K, L, | A, C, D, E, G, H, K, L, |
|  | P12N_R | SEQ ID NO: 199 | N, Q, R, S, T, V, W, Y, I | N, Q, R, S, T, V, W, Y |
| V15 | V15N_F | SEQ ID NO: 200 | A, C, I, M, R, D, F, G, | A, C, I, M, R |
|  | V15N_R | SEQ ID NO: 201 | H, L, P, Q, S, T, W, Y |  |

TABLE 23-continued

| Position | Oligo Name | Oligo sequence identifier | Identified Substitutions | Active Substitutions |
|---|---|---|---|---|
| A16 | A16N_F<br>A16N_R | SEQ ID NO: 202<br>SEQ ID NO: 203 | C, D, E, F, G, H, I, K, L, M, N, P, Q, R, S, T, V, W, Y | none |
| H19 | H19N_F<br>H19N_R | SEQ ID NO: 204<br>SEQ ID NO: 205 | A, E, K, L, P, R, S, Y,<br>C, D, F, G, I, M, N, T, V, W | A, E, K, L, P, R, S, Y |
| W20 | NNK20_F<br>MNN20_R | SEQ ID NO: 206<br>SEQ ID NO: 207 | A, T, D, E, G, I, K, L, M, N, P, Q, R, S, V, Y | A, T |
| D23 | NNK23_F<br>MNN23_R | SEQ ID NO: 208<br>SEQ ID NO: 209 | A, G, H, K, M, N, Q, S, T, V, C, L, P, R, W, Y | A, G, H, K, M, N, Q, S, T, V |
| G24 | NNK24_F<br>MNN24_R | SEQ ID NO: 210<br>SEQ ID NO: 211 | D, F, A, E, H, I, L, M, N, P, R, S, T, V, W, Y | D, F |
| S27 | S27N_F<br>S27N_R | SEQ ID NO: 212<br>SEQ ID NO: 213 | A, C, D, E, F, G, H, N, Q, R, T, I, K, L, M, P, W, Y | A, C, D, E, F, G, H, N, Q, R, T |
| S30 | S30N_F<br>S30N_R | SEQ ID NO: 214<br>SEQ ID NO: 215 | A, C, D, E, F, G, H, K, L, M, N, P, Q, R, T, V, W, Y | A, C, D, E, F, G, H, K, L, M, N, P, Q, R, T, V, W, Y |
| V31 | V31N_F<br>V31N_R | SEQ ID NO: 216<br>SEQ ID NO: 217 | I, L, A, C, D, E, F, G, H, K, N, P, Q, R, S, T, W, Y | I, L |
| G32 | G32N_F<br>G32N_R | SEQ ID NO: 218<br>SEQ ID NO: 219 | A, D, E, F, H, K, L, M, N, P, Q, R, S, T, V, W, Y | A, D, E, F, H, K, L, M, N, P, Q, R, S, T, V, W, Y |
| N33 | N33N_F<br>N33N_R | SEQ ID NO: 220<br>SEQ ID NO: 221 | A, C, D, E, F, G, H, I, K, L, P, Q, R, S, T, V, Y, W | A, C, D, E, F, G, H, I, K, L, P, Q, R, S, T, V, Y |
| G34 | NNK34_F<br>MNN34_R | SEQ ID NO: 222<br>SEQ ID NO: 223 | E, F, H, K, L, M, N, Q, R, S, T, Y, I, P, V, W | E, F, H, K, L, M, N, Q, R, S, T, Y |
| K53 | K53N_F<br>K53N_R | SEQ ID NO: 224<br>SEQ ID NO: 225 | A, C, D, E, F, H, I, L, M, N, p, Q, R, S, T, V, Y, G, W | A, C, D, E, F, H, I, L, M, N, Q, R, S, T, V, Y |
| A56 | A56N_F<br>A56N_R | SEQ ID NO: 226<br>SEQ ID NO: 227 | G, L, N, P, Q, R, S, T, C, D, E, F, H, I, K, Y | G, L, N, P, Q, R, S, T |
| H58 | H58N_F<br>H58N_R | SEQ ID NO: 228<br>SEQ ID NO: 229 | A, D, F, L, M, N, R, W, Y, C, G, I, K, P, S, T, V | A, D, F, L, M, N, R, W, Y |
| Y60 | NNK60_F<br>MNN60_R | SEQ ID NO: 230<br>SEQ ID NO: 231 | E, F, A, D, G, I, K, L, M, N, P, Q, R, S, T, V | E, F |
| Y61 | NNK61_F<br>MNN61_R | SEQ ID NO: 232<br>SEQ ID NO: 233 | A, C, D, G, I, K, L, N, P, R, S, T, V, W | none |
| S65 | S65N_F<br>S65N_R | SEQ ID NO: 234<br>SEQ ID NO: 235 | A, C, D, E, F, G, H, I, L, N, T, V, P, R, Y | A, C, D, E, F, G, H, I, L, N, T, V |
| S66 | NNK66_F<br>MNN66_R | SEQ ID NO: 236<br>SEQ ID NO: 237 | A, G, C, D, E, I, K, L, M, N, P, R, T, V, W | A, G |
| I68 | NNK68_F<br>MNN68_R | SEQ ID NO: 238<br>SEQ ID NO: 239 | D, L, V, A, C, E, F, G, H, K, M, N, P, Q, R, T, W, Y | D, L, V |
| V70 | V70N_F<br>V70N_R | SEQ ID NO: 240<br>SEQ ID NO: 241 | C, I, A, D, F, G, H, L, M, N, P, Q, R, S, T, Y | C, I |
| D71 | D71N_F<br>D71N_R | SEQ ID NO: 242<br>SEQ ID NO: 243 | A, C, G, H, I, L, M, N, S, T, V, Y, F, P, R | A, C, G, H, I, L, M, N, S, T, V, Y |
| N73 | N73N_F<br>N73N_R | SEQ ID NO: 244<br>SEQ ID NO: 245 | A, C, D, F, G, H, I, L, R, S, T, V, Y, P | A, C, D, F, G, H, I, L, R, S, T, V, Y |
| A74 | A74N_F<br>A74N_R | SEQ ID NO: 246<br>SEQ ID NO: 247 | C, D, F, G, H, I, L, N, Q, R, S, T, V, Y, P | C, D, F, G, H, I, L, N, Q, R, S, T, V, Y |
| V75 | NNK75_F<br>MNN75_R | SEQ ID NO: 248<br>SEQ ID NO: 249 | C, I, L, A, D, F, G, H, K, M, P, Q, R, S, T, W, Y | C, I, L |
| D77 | NNK77_F<br>MNN77_R | SEQ ID NO: 250<br>SEQ ID NO: 251 | Y, A, E, F, G, H, K, L, M, N, P, Q, R, T, V, W | Y |
| Q78 | Q78N_F<br>Q78N_R | SEQ ID NO: 252<br>SEQ ID NO: 253 | A, C, D, F, G, H, I, L, M, N, R, S, T, V, Y, P | A, C, D, F, G, H, I, L, M, N, R, S, T, V, Y |
| R79 | NNK79_F<br>MNN79_R | SEQ ID NO: 254<br>SEQ ID NO: 255 | A, C, D, E, F, H, K, L, N, Q, R, S, T, W, Y, I, P, V | A, C, D, E, F, H, K, L, N, Q, R, S, T, W, Y |
| R80 | R80N_F<br>R80N_R | SEQ ID NO: 256<br>SEQ ID NO: 257 | A, C, D, F, G, H, I, L, N, S, T, V, Y, P | A, C, D, F, G, H, I, L, N, S, T, V, Y |
| L81 | L81N_F<br>L81N_R | SEQ ID NO: 258<br>SEQ ID NO: 259 | A, C, D, F, G, H, I, N, P, R, S, T, V, Y | A, C, D, F, G, H, I, N, P, R, S, T, V |
| E83 | E83N_F<br>E83N_R | SEQ ID NO: 260<br>SEQ ID NO: 261 | A, C, D, F, G, H, I, K, L, N, P, R, S, T, V, Y | A, C, D, F, G, H, I, K, L, N, P, R, S, T, V, Y |
| P84 | NNK84_F<br>MNN84_R | SEQ ID NO: 262<br>SEQ ID NO: 263 | A, C, E, I, S, V, W, Y, F, G, H, L, N, R, T | A, C, E, I, S, V, W, Y |

TABLE 23-continued

| Position | Oligo Name | Oligo sequence identifier | Identified Substitutions | Active Substitutions |
|---|---|---|---|---|
| L85 | L85N_F<br>L85N_R | SEQ ID NO: 264<br>SEQ ID NO: 265 | C, G, V, A, D, E, F, H,<br>I, N, P, Q, R, S, T, Y | C, G, V |
| S86 | S86N_F<br>S86N_R | SEQ ID NO: 266<br>SEQ ID NO: 267 | A, I, T, V, C, D, F, G,<br>H, L, M, N, P, Q, R, Y | A, I, T, V |

Example 11—Identification of Motif 1 and Analysis of Amino Acid Positions Affecting the Function of PIP-72Aa From the protein sequence alignment of PIP-72Aa (SEQ ID NO: 2) and other active family members including PIP-72 Da (SEQ ID NO: 10), PIP-72Fa (SEQ ID NO: 18), GBP_A3175 (SEQ ID NO: 20) and PIP-72Gb (SEQ ID NO: 32) shown in FIG. 2, the conserved Motif 1 was identified as potentially important for function (underlined in FIG. 2 relative to PIP-72Aa (SEQ ID NO: 2). Each position within Motif 1 (37, 38, 39, 40, 41, 42, 43, 44, 45, 46, 47, 48, 49, 50 and 51) was subjected to saturation mutagenesis using the oligonucleotide primers indicated in Table 24. The resulting plasmid DNAs were transformed into *E. coli* and protein was expressed as described in Example 3. Bioassays were performed on Western Corn Root Worm as described in Example 4 to determine which gene variants retained insecticidal activity. Table 24 lists the positions that were mutagenized and summarizes the data that was obtained. For each position, the amino acid substitutions which yielded PIP-72A polypeptide variants that retained Western Corn Root Worm activity are shown. Also, the amino acid substitutions associated with soluble protein expression in *E. coli* are noted.

TABLE 24

| Residue | Oligo Name | Sequence identifier | Identified Substitutions | Active Substitutions | Soluble Expression |
|---|---|---|---|---|---|
| E37 | 37nnk_F | SEQ ID NO: 268 | A, C, D, E, F, G, I, K, L, M, N, S, T, V, H P, R, W, Y | A, C, D, F, G, I, K, L, M, N, S, T, V | A, C, D, E, F, G, I, K, L, M, M, S, T, V, H, R, W, Y |
| T38 | T38N_F<br>T38N_R | SEQ ID NO: 269<br>SEQ ID NO: 270 | A, C, D, E, F, G, H, I, L, M, N, Q, R, S, V, W, Y, K, P | A, C, D, E, F, G, H, I, L, M, N, Q, R, S, V, W, Y | A, C, D, E, F, G, H, I, L, M, N, Q, R, S, V, W, Y |
| W39 | 39nnk_F | SEQ ID NO: 271 | F, A, C, D, E, G, H, I, K, L, M, N, P, Q, R, S, T, V, Y | F | F, W, Y |
| D40 | 40nnk_F | SEQ ID NO: 272 | A, C, E, F, G, H, I, K, L, M, N, Q, R, S, T, V, W, Y, P | A, C, E, F, G, H, I, K, L, M, N, Q, R, S, T, V, W, Y | A, C, D, E, F, G, H, I, K, L, M, N, Q, R, S, T, V, W, Y, P |
| R41 | 41nnk_F | SEQ ID NO: 273 | A, C, D, E, F, G, I, K, L, M, N, P, Q, S, T, V, W, Y | none | F, I, L, N, V |
| S42 | 42nnk_F | SEQ ID NO: 274 | A, C, D, E, F, G, I, K, L, M, N, Q, R, S, T, V, W, Y, P | A, C, D, E, F, G, I, K, L, M, N, Q, R, T, V, W, Y | A, C, D, E, F, G, I, K, L, M, N, Q, R, S, T, V, W, Y, P |
| D43 | 43nnk_F | SEQ ID NO: 275 | A, C, E, F, G, H, I, K, L, N, P, Q, R, S, T, V, W, Y | none | |
| S44 | S44N_F<br>S44N_R | SEQ ID NO: 276<br>SEQ ID NO: 277 | A, D, E, G, L, M, N, P, Q, T, V, Y, H, I, K, R, W | A, D, E, G, L, M, N, P, Q, T, V, Y | A, D, E, G, L, M, N, P, Q, T, V, Y, H, I, K, R, W |
| R45 | 45nnk_F | SEQ ID NO: 278 | K, R, S, A, C, D, E, F, G, H, L, M, N, P, Q, T, V, W, Y | K, S | K, R, L, M, Q, S, Y |
| G46 | 46nnk_F | SEQ ID NO: 279 | A, Q, C, D, E, F, H, I, K, L, M, N, P, R, S, T, V, W, Y | A, Q | A, G, Q |
| F47 | 47nnk_F | SEQ ID NO: 280 | C, V, Y, A, D, E, G, H, I, K, L, M, N, P, Q R, S, T, W | C, V, Y | C, F, V, Y, H, L, M |
| V48 | 48nnk_F | SEQ ID NO: 281 | I, L, A, C, D, E, F, G, H, K, M, N, P, Q, R, S, W | I, L | I, L, V |
| L49 | 49nnk_F | SEQ ID NO: 282 | C, F, M, R, Y, A, D, E, G, H, I, K, N, P, Q, S, T, V, W | C, F, M, R, Y | C, F, L, M, R, Y |
| S50 | 50nnk_F | SEQ ID NO: 283 | A, C, D, I, M, P, Q, S, T, V, F, G, H, K, L, N, R, W, Y | A, C, D, I, M, P, Q, T, V | A, C, D, I, M, Q, S, T, V, F, H, L, N, R, W, Y |
| L51 | 51nnk_F | SEQ ID NO: 284 | A, C, M, V, D, E, F, G, H, K, N, P, Q, R, S, T, W, Y | A, C, M, V | A, C, L, M, V |

Example 12—PIP-72Aa Variants with Multiple Amino Acid Substitutions in Motif 1

PIP-72Aa variants with multiple selected amino acid substitutions in Motif 1 were generated by the QuikChange™ technique (Agilent, Santa Clara Calif.) using a combination of the oligonucleotide primers indicated in Table 25. The resulting plasmid DNAs were transformed into *E. coli*, and protein was expressed as described in Example 3. Bioassays were performed on Western Corn Root Worm as described in Example 4 to determine which gene variants retained insecticidal activity. DNA sequencing was performed on the active gene variants. The nucleotide and amino acid sequences of active variants are listed in Table 26. Out of 78 variants screened, 20 had detectable Western Corn Root Worm activity. The active variants contained between 2 and 7 amino acid substitutions relative to PIP-72Aa (SEQ ID NO: 2). Table 27 shows the amino acid substitutions of the resulting active PIP-72 polypeptide variants compared to PIP-72Aa (SEQ ID NO: 2).

TABLE 25

| primer | Sequence identifier | primer | Sequence identifier |
|---|---|---|---|
| CombiMM1:1_T | SEQ ID NO: 773 | CombiMM1:17_T | SEQ ID NO: 789 |
| CombiMM1:2_T | SEQ ID NO: 774 | CombiMM1:18_T | SEQ ID NO: 790 |
| CombiMM1:3_T | SEQ ID NO: 775 | CombiMM1:19_T | SEQ ID NO: 791 |
| CombiMM1:4_T | SEQ ID NO: 776 | CombiMM1:20_T | SEQ ID NO: 792 |
| CombiMM1:5_T | SEQ ID NO: 777 | CombiMM1:21_T | SEQ ID NO: 793 |
| CombiMM1:6_T | SEQ ID NO: 778 | CombiMM1:22_T | SEQ ID NO: 794 |
| CombiMM1:7_T | SEQ ID NO: 779 | CombiMM1:23_T | SEQ ID NO: 795 |
| CombiMM1:8_T | SEQ ID NO: 780 | CombiMM1:24_T | SEQ ID NO: 796 |
| CombiMM1:9_T | SEQ ID NO: 781 | CombiMM1:25_T | SEQ ID NO: 797 |
| CombiMM1:10_T | SEQ ID NO: 782 | CombiMM1:26_T | SEQ ID NO: 798 |
| CombiMM1:11_T | SEQ ID NO: 783 | CombiMM1:27_T | SEQ ID NO: 799 |
| CombiMM1:12_T | SEQ ID NO: 784 | CombiMM1:28_T | SEQ ID NO: 800 |
| CombiMM1:13_T | SEQ ID NO: 785 | CombiMM1:29_T | SEQ ID NO: 801 |
| CombiMM1:14_T | SEQ ID NO: 786 | CombiMM1:30_T | SEQ ID NO: 802 |
| CombiMM1:15_T | SEQ ID NO: 787 | CombiMM1:31_T | SEQ ID NO: 803 |
| CombiMM1:16_T | SEQ ID NO: 788 | CombiMM1:32_T | SEQ ID NO: 804 |

TABLE 26

| % ID PIP-72Aa | Clone Designation | Polynucleotide | Polypeptide |
|---|---|---|---|
| 95.35% | D_D0416473 | SEQ ID NO: 805 | SEQ ID NO: 825 |
| 95.35% | D_D0416474 | SEQ ID NO: 806 | SEQ ID NO: 826 |
| 96.51% | D_D0416483 | SEQ ID NO: 807 | SEQ ID NO: 827 |
| 94.19% | D_D0416488 | SEQ ID NO: 808 | SEQ ID NO: 828 |
| 95.35% | D_D0416490 | SEQ ID NO: 809 | SEQ ID NO: 829 |
| 97.67% | D_D0416492 | SEQ ID NO: 810 | SEQ ID NO: 830 |
| 97.67% | D_D0416493 | SEQ ID NO: 811 | SEQ ID NO: 831 |
| 95.35% | D_D0416502 | SEQ ID NO: 812 | SEQ ID NO: 832 |
| 96.51% | D_D0416506 | SEQ ID NO: 813 | SEQ ID NO: 833 |
| 94.19% | D_D0416507 | SEQ ID NO: 814 | SEQ ID NO: 834 |
| 94.19% | D_D0416514 | SEQ ID NO: 815 | SEQ ID NO: 835 |
| 94.19% | D_D0416520 | SEQ ID NO: 816 | SEQ ID NO: 836 |
| 91.86% | D_D0416521 | SEQ ID NO: 817 | SEQ ID NO: 837 |
| 96.51% | D_D0416527 | SEQ ID NO: 818 | SEQ ID NO: 838 |
| 94.19% | D_D0416528 | SEQ ID NO: 819 | SEQ ID NO: 839 |
| 95.35% | D_D0416542 | SEQ ID NO: 820 | SEQ ID NO: 840 |
| 94.19% | D_D0416543 | SEQ ID NO: 821 | SEQ ID NO: 841 |
| 95.35% | D_D0416551 | SEQ ID NO: 822 | SEQ ID NO: 842 |
| 91.86% | D_D0416552 | SEQ ID NO: 823 | SEQ ID NO: 843 |
| 95.35% | D_D0416555 | SEQ ID NO: 824 | SEQ ID NO: 844 |

TABLE 27

| Clone des. | polypeptide | Substitutions relative to SEQ ID NO: 2 |
|---|---|---|
| D_D0416473 | SEQ ID NO: 825 | E037V, T038S, D040E, S044A |
| D_D0416474 | SEQ ID NO: 826 | E037V, D040G, S044A, S050G |
| D_D0416483 | SEQ ID NO: 827 | L049M, S050C, L051M |
| D_D0416488 | SEQ ID NO: 828 | T038G, S044A, L049M, S050C, L051M |
| D_D0416490 | SEQ ID NO: 829 | D040G, S042T, S044N, S050C |
| D_D0416492 | SEQ ID NO: 830 | S050C, L051M |
| D_D0416493 | SEQ ID NO: 831 | S044N, L049M |
| D_D0416502 | SEQ ID NO: 832 | E037V, T038S, D040A, S050C |
| D_D0416506 | SEQ ID NO: 833 | E037C, T038G, S050C |
| D_D0416507 | SEQ ID NO: 834 | E037V, T038G, S044A, L049M, S050A |
| D_D0416514 | SEQ ID NO: 835 | E037V, T038G, D040E, S044N, S050C |
| D_D0416520 | SEQ ID NO: 836 | E037C, T038G, S042T, S044N, L049M |
| D_D0416521 | SEQ ID NO: 837 | E037V, T038S, D040G, S044A, V048I, S050C, L051M |
| D_D0416527 | SEQ ID NO: 838 | T038G, S042T, S050C |
| D_D0416528 | SEQ ID NO: 839 | E037D, D040A, S042T, L049M, S050C |
| D_D0416542 | SEQ ID NO: 840 | E037C, D040G, L049M, S050A |
| D_D0416543 | SEQ ID NO: 841 | E037C, T038S, D040E, S042T, S050C |
| D_D0416551 | SEQ ID NO: 842 | E037V, T038S, D040A, S042N |
| D_D0416552 | SEQ ID NO: 843 | E037V, D040E, S042T, S044N, S050C, L051M |
| D_D0416555 | SEQ ID NO: 844 | E037D, T038S, S044A, S050C |

Example 13—Identification of Additional Amino Acid Positions Affecting the Function of PIP-72Aa The remaining amino acid positions 2, 3, 4, 5, 6, 9, 13, 14, 17, 18, 21, 22, 25, 26, 28, 29, 35, 36, 52, 54, 55, 57, 59, 62, 63, 64, 67, 69, 72, 76, 82 were subjected to saturation mutagenesis as described in Example 11, using the oligonucleotide primers indicated in Table 27. The resulting plasmid DNAs were transformed into *E. coli*, and protein was expressed as described in Example 3. Bioassays were performed on Western Corn Root Worm as described in Example 4 to determine which gene variants retained insecticidal activity. Table 28 lists the positions that were mutagenized and summarizes the amino acid substitutions identified by DNA sequencing and the amino acid substitutions which yielded PIP-72Aa variants that retained Western Corn Root Worm activity are shown.

TABLE 28

| POSITION | OLIGO NAME | SEQUENCE IDENTIFIER | IDENTIFIED SUBSTITUTIONS | ACTIVE SUBSTITUTIONS |
|---|---|---|---|---|
| G2 | NNK2_HM | SEQ ID NO: 865 | A, C, D, E, I, K, L, N, R, S, T, V, W, Y | A, C, D, E, I, K, L, N, R, S, T, V, W, Y |
| I3 | NNK3_HM | SEQ ID NO: 866 | A, C, D, E, F, G, H, L, N, P, Q, R, S, V, W, Y | W |
| T4 | NNK4_HM | SEQ ID NO: 867 | A, D, E, F, G, H, I, K, L, P, R, S, V, W, Y | A, D, E, H, I, K, L, R, S, V, W, Y |
| V5 | NNK5_HM | SEQ ID NO: 868 | A, C, E, G, H, I, K, L, N, Q, R, S, T, W, Y | A, C, G, H, I, Y |
| T6 | NNK6_HM | SEQ ID NO: 869 | A, C, D, E, F, G, H, I, K, L, M, N, P, Q, R, S, V, W, Y | A, C, F, G, H, I, K, M, P, Q, R, S, W, Y |
| S9 | NNK9 MNN9 | SEQ ID NO: 889 SEQ ID NO: 890 | A, C, D, E, F, G, H, I, K, L, M, P, Q, R, T, V, W, Y | A, C, G, T |

TABLE 28-continued

| POSITION | OLIGO NAME | SEQUENCE IDENTIFIER | IDENTIFIED SUBSTITUTIONS | ACTIVE SUBSTITUTIONS |
|---|---|---|---|---|
| I13 | NNK13_HM | SEQ ID NO: 870 | A, C, D, F, G, H, K, L, M, N, P, Q, R, S, T, V, W, Y | N, Q, V |
| E14 | NNK14_HM | SEQ ID NO: 871 | A, C, D, F, G, H, K, L, M, N, P, Q, R, S, T, V, W, Y | A, C, F, H, K, Q |
| I17 | NNK17_HM | SEQ ID NO: 872 | A, C, D, E, F, G, H, K, L, M, N, P, Q, R, S, T, V, W, Y | E, V |
| N18 | NNK18_HM | SEQ ID NO: 873 | A, C, D, E, F, G, H, I, K, L, M, Q, R, S, T, V, Y | S |
| G21 | NNK21_HM | SEQ ID NO: 874 | A, D, F, I, L, M, P, R, S, T, V, W | NONE |
| S22 | NNK22_HM | SEQ ID NO: 875 | A, C, D, E, F, G, H, I, K, L, M, N, P, Q, R, T, V, W, Y | A, D, F, G, H, I, K, L, M, N, P, Q, R, T, V, Y |
| D25 | NNK25_HM | SEQ ID NO: 876 | A, C, E, F, G, H, L, N, P, Q, R, S, V, W | A, E, F, N, Q |
| T26 | NNK26_HM | SEQ ID NO: 877 | A, C, D, E, F, G, H, I, K, L, M, N, P, Q, R, S, V, W, Y | E, P |
| F28 | NNK28 MNN28 | SEQ ID NO: 891 SEQ ID NO: 892 | A, C, D, E, G, H, I, K, L, M, N, P, Q, R, S, T, V, W, Y | P, W, Y |
| F29 | NNK29 MNN29 | SEQ ID NO: 893 SEQ ID NO: 894 | A, C, D, E, G, H, I, K, L, M, N, P, S, T, V, W, Y | A, C, I, L, Q, R, W, Y |
| K35 | NNK35 MNN35 | SEQ ID NO: 895 SEQ ID NO: 896 | A, C, D, G, H, I, L, M, N, P, Q, R, S, T, V, W, Y | A, C, D, G, H, I, L, M, N, Q, R, S, T, V |
| Q36 | NNK36_HM | SEQ ID NO: 878 | A, C, E, G, H, I, K, L, M, N, P, R, S, T, V, W, Y | A, C, E, G, H, I, K, L, N, P, R, S, T, V |
| K52 | NNK52 MNN52 | SEQ ID NO: 897 SEQ ID NO: 898 | A, C, D, E, F, G, H, I, L, M, N, P, R, S, T, V, W, Y | C, F, H, I, L, M, N, R, S, T, W, Y |
| N54 | NNK54_HM | SEQ ID NO: 879 | A, C, D, E, F, G, I, K, L, M, P, Q, R, S, T, V, W, Y | C, D, E, F, G, K, M, Q, R, S, W |
| G55 | NNK55_HM | SEQ ID NO: 880 | A, C, D, E, F, H, I, K, L, M, N, P, Q, R, S, T, V, W, Y | NONE |
| Q57 | NNK57_HM | SEQ ID NO: 881 | A, C, D, E, F, G, H, I, K, L, M, P, R, S, T, V, W | E, L, M, S, T |
| P59 | NNK59_HM | SEQ ID NO: 882 | A, C, D, E, F, G, H, I, K, L, M, N, Q, R, S, T, V, W, Y | NONE |
| V62 | NNK62_HM | SEQ ID NO: 883 | A, C, D, E, F, G, H, K, L, M, N, P, Q, R, S, T, W, Y | NONE |
| Q63 | NNK63_HM | SEQ ID NO: 884 | A, C, D, E, F, G, H, I, K, L, M, N, P, R, S, T, V, W, Y | C, G, I, L, M, N, T, V, Y |
| A64 | NNK64_HM | SEQ ID NO: 885 | C, D, E, F, G, H, I, K, L, M, N, P, Q, R, S, T, V, W, Y | F, G, H, R, S, Y |
| K67 | NNK67 MNN67 | SEQ ID NO: 899 SEQ ID NO: 900 | A, C, D, F, G, H, I, L, M, N, P, Q, R, S, T, V, W, Y | A, C, D, F, H, I, L, M, N, Q, R, S, T, V, W, Y |
| E69 | NNK69_HM | SEQ ID NO: 886 | A, C, D, F, G, H, I, K, L, M, N, P, Q, R, S, T, V, Y | A, C, D, F, H, I, L, M, Q, R, S, T, V, Y |
| N72 | NNK72_HM | SEQ ID NO: 887 | A, C, D, E, F, G, I, K, L, M, P, Q, R, S, T, V, W, Y | A, C, D, E, G, K, M, P, Q, R, S, T, V, W |
| K76 | NNK76 MNN76 | SEQ ID NO: 901 SEQ ID NO: 902 | A, C, D, E, F, G, H, I, L, N, P, Q, R, S, T, V, W, Y | A, C, F, H, I, L, Q, R, S, T, V, W, Y |
| I82 | NNK82_HM | SEQ ID NO: 888 | A, D, E, F, G, H, K, L, M, N, P, Q, R, S, T, V, W, Y | A, L, M, R, V |

Example 14—PIP-72Aa Variants with Improved Activity Against Western Corn Rootworm To create variants of PIP-72Aa (SEQ ID NO: 2) with increased Western corn rootworm activity, libraries were generated by synthetic DNA shuffling (Ness et al, 2002, *Nature Biotechnology* 20, 1251-5) of PIP-72Aa (SEQ ID NO: 1) and by site-directed mutagenesis (QuikChange™ Lightning technique or QuikChange™ II technique, Agilent, Santa Clara Calif.). Twelve PIP-72 variant polypeptides with increased specific activity against Western corn rootworm were identified. The PIP-72 variant polypeptides A5, A5:10E, A5:10T, A5:10V, A5:10A, A5:10L, A5:10E/78H, A5:8M, A5:71H/83F, A5:4S/54Q/78H, A5:71 H and 3_68 exhibited between about 1.2 and 2-fold improved insecticidal activity against Western corn rootworm compared to PIP-72Aa (SEQ ID NO: 2). Table 29 shows the amino acid substitutions compared to PIP-72Aa (SEQ ID NO: 2) for each of the PIP-72 variant polypeptides, the corresponding amino acid sequence identifier, and the corresponding nucleic acid sequence identifier. Amino acid substitutions compared to A5 (SEQ ID NO: **) are bolded.

TABLE 29

| Variant | a.a. substitutions compared to SEQ ID NO: 2 | Polypeptide sequence | Polynucleotide sequence |
|---|---|---|---|
| 72Aa | | SEQ ID NO: 2 | SEQ ID NO: 1 |
| Combi3_68 | S10E, L49M, E83Y | SEQ ID NO: 903 | SEQ ID NO: 915 |
| A5 | S30G, V31I, G32D, N33S, T38S, K53R, H57A | SEQ ID NO: 904 | SEQ ID NO: 916 |
| A5:10E | S10E, S30G, V31I, G32D, N33S, T38S, K53R, H57A | SEQ ID NO: 905 | SEQ ID NO: 917 |
| A5:10T | S10T, S30G, V31I, G32D, N33S, T38S, K53R, H57A | SEQ ID NO: 906 | SEQ ID NO: 918 |
| A5:10V | S10V, S30G, V31I, G32D, N33S, T38S, K53R, H57A | SEQ ID NO: 907 | SEQ ID NO: 919 |
| A5:10A | S10A, S30G, V31I, G32D, N33S, T38S, K53R, H57A | SEQ ID NO: 908 | SEQ ID NO: 920 |
| A5:10L | S10L, S30G, V31I, G32D, N33S, T38S, K53R, H57A | SEQ ID NO: 909 | SEQ ID NO: 921 |
| A5:10E/78H | S10E, S30G, V31I, G32D, N33S, T38S, K53R, H57A, Q78H | SEQ ID NO: 910 | SEQ ID NO: 922 |
| A5:8M | N8M, S30G, V31I, G32D, N33S, T38S, K53R, H57A | SEQ ID NO: 911 | SEQ ID NO: 923 |
| A5:71H/83F | S30G, V31I, G32D, N33S, T38S, K53R, H57A, D71H, E83F | SEQ ID NO: 912 | SEQ ID NO: 924 |
| A5:4S/54Q/78H | S30G, V31I, G32D, N33S, T38S, K53R, N54Q, H57A, Q78H | SEQ ID NO: 913 | SEQ ID NO: 925 |
| A5:71H | S30G, V31I, G32D, N33S, T38S, K53R, H57A, D71H | SEQ ID NO: 914 | SEQ ID NO: 926 |

To determine Western corn rootworm activity, test proteins were assayed as described in Example 4. A 0-3 numerical scoring system based on the size and mortality was used. If no response or normal growth was seen, Score 0 was given. When the growth was somewhat retarded without any mortality, it was Score 1. Score 2 meant partial death (multiple insects were used in each well) and strong growth inhibition. Score 3 indicated the complete mortality. Each treatment was repeated 6 times for possible highest score of 18. In this scoring system, Score 9 with 6 repeats of one treatment means the 50% response (9 out of 18) of the treatment and called ILC50 (growth Inhibition and Lethal Concentration for 50% response). Activity data is shown in Table 30. Converted ILC50 numbers represent averages of between 2 and 20 experiments.

TABLE 30

| Variant | converted ILC50 | converted lower range | converted upper range | fold Improvement | |
|---|---|---|---|---|---|
| PIP-72Aa SEQ ID NO: 2 | 56.68 | 48.32 | 66.69 | 1 | n = 18 |
| 3_68 SEQ ID NO: 903 | 48.86 | 40.78 | 58.22 | 1.16 | n = 4 |
| A5 SEQ ID NO: 904 | 36.68 | 30.76 | 43.24 | 1.55 | n = 20 |
| A5:10E SEQ ID NO: 905 | 33.96 | 27.78 | 41.01 | 1.67 | n = 10 |
| A5:10T SEQ ID NO: 906 | 30.54 | 23.78 | 38.48 | 1.86 | n = 4 |
| A5:10V SEQ ID NO: 907 | 31.35 | 25.69 | 37.87 | 1.81 | n = 4 |
| A5:10A SEQ ID NO: 908 | 42.38 | 35.61 | 50.27 | 1.34 | n = 2 |
| A5:10L SEQ ID NO: 909 | 39.05 | 31.87 | 47.78 | 1.45 | n = 2 |
| A5:10E/78H SEQ ID NO: 910 | 36.04 | 28.64 | 44.66 | 1.57 | n = 10 |
| A5:8M SEQ ID NO: 911 | 25.02 | 19.34 | 30.90 | 2.27 | n = 6 |
| A5:71H/83F SEQ ID NO: 912 | 32.24 | 26.72 | 38.44 | 1.78 | n = 4 |
| A5:4S/54Q/78H SEQ ID NO: 913 | 29.01 | 23.42 | 35.20 | 1.95 | n = 4 |
| A5:71H SEQ ID NO: 914 | 26.82 | 20.57 | 33.75 | 2.1 | n = 2 |

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for.

SEQUENCE LISTING (980 sequences)

SEQ ID NO: 1 - DNA, 261 bp, Pseudomonas chlororaphis
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 2 - protein, 86 aa, Pseudomonas chlororaphis
MGITVTNNSSNPIEVAINHWGSDGDTSFFSVGNGKQETWDRSDSRGFVLSLKKNGAQHPYYVQASSKIEVDNNAVKDQGRLIEPLS

SEQ ID NO: 3 - DNA, 261 bp, Pseudomonas rhodesiae
atgggtattactgttaaaaacaattcatccaacacaattgaagttgcagtcaaccattggggaaaagatggggatacaagcttcttctcaatcgctaacggcaagcaggaaagctgggacaggtctgacagtcgcggctttgtactctccttaaagagaaatggagcacaacacccatactatgttcaggccagtagccaaattgaagttgaccataacgcagtgaaggatcatggcgagcctattcacccgctctcgtaa

SEQ ID NO: 4 - protein, 86 aa, Pseudomonas rhodesiae
MGITVKNNSSNTIEVAVNHWGKDGDTSFFSIANGKQESWDRSDSRGFVLSLKRNGAQHPYYVQASSQIEVDHNAVKDHGEPIHPLS

SEQ ID NO: 5 - DNA, 261 bp, Pseudomonas chlororaphis
atgggtattaccgttaccaacaaatcatcgaaaaagattgaagtctcgatcaacaaatggggcagcgacggcgacaccaccttctttggagtcgacagcggcaagcaggaaagctgggaccgatcggacgaccgtggctttgtgctgtccctgaaaagaaacggcacccaggcgccttactatgtacaggcaacgagcaagatcgaagttgatagcagcaccgtgaaagaccacggtgagactattcacccggtcgcctga

SEQ ID NO: 6 - protein, 86 aa, Pseudomonas chlororaphis
MGITVTNKSSKKIEVSINKWGSDGDTTFFGVDSGKQESWDRSDDRGFVLSLKRNGTQAPYYVQATSKIEVDSSTVKDHGETIHPVA

SEQ ID NO: 7 - DNA, 261 bp, Pseudomonas mandelii
atgggtattaccgttaccaacaaatcatcgaaaaagattgaagtctcggtcaacaaatggggcagcgacggcgacaccaccttctttggaatcgacagcggcaagcaggaaagctgggacagatcggacgaccgtggctttgtgctgtccctgaaaaggaacggcacccaggcgccttactatgtccaggccacgagcaagatcgaagttgatagcagcaccgtgaaagaccacggtgagactattcacccggtcgcctaa

SEQ ID NO: 8 - protein, 86 aa, Pseudomonas mandelii
MGITVTNKSSKKIEVSVNKWGSDGDTTFFGIDSGKQESWDRSDDRGFVLSLKRNGTQAPYYVQATSKIEVDSSTVKDHGETIHPVA

SEQ ID NO: 9 - DNA, 258 bp, Pseudomonas congelans
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaaaaggaacggcacccaggcgccttactatgtacaggccacgagcaagatcgaaattgaaaacagtacggtgaaagaccacggtgaaaccattcacccggtcgcg

SEQ ID NO: 10 - protein, 86 aa, Pseudomonas congelans
MGITVTNKSSKKIEASINKWGSDGDTKFFGIDSGKQESWDRSDDRGFVLSLKRNGTQAPYYVQATSKIEIENSTVKDHGETIHPVA

SEQ ID NO: 11 - DNA, 261 bp, Pseudomonas mandelii
atgggtattaccgttaccaacaaatcatcgaaaaaaattgaagcctcgatcaacaaatggggtagcgacggcgacaccaaattcttcggaatcgatagcggcaagcaggaaagctgggacagatcagacgatcgcggctttgtgctatccctgaaaaggaacggcacccaggcgccttactatgtacaggccacgagcaagatcgaagttgaaaacagtatggtgaaagaccacggcgaaactattcacccggtcgcgtaa

SEQ ID NO: 12 - protein, 86 aa, Pseudomonas mandelii
MGITVTNKSSKKIEASINKWGSDGDTKFFGIDSGKQESWDRSDDRGFVLSLKRNGTQAPYYVQATSKIEVENSMVKDHGETIHPVA

SEQ ID NO: 13 - DNA, 261 bp, Pseudomonas ficuserectae
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaaaaggaacggcacccaggcgccttactatgtacaggccacgagcaagatcgaaattgaaaacagtgcggtgaaagaccacggtgaaaccattcacccggtcgcgtaa

SEQ ID NO: 14 - protein, 86 aa, Pseudomonas ficuserectae
MGITVTNKSSKKIEASINKWGSDGDTKFFGIDSGKQESWDRSDDRGFVLSLKRNGTQAPYYVQATSKIEIENSAVKDHGETIHPVA

SEQ ID NO: 15 - DNA, 264 bp, Pseudomonas congelans
atgagcattaccgttaaaaataacacctcgaatataattgaagttgccattaaccaatgggacacggacggcgacactcgttactctccgctcgctgcgggagcatcagataagtgggttagaaaggacagtagaggatatgttctttcactaagacaaggaggtactgaaaagccatattacgtactggttgacagcaacattgtggttgccaacactgaggtaaaagacaacgatacggttatttctccaatcagtagataa

SEQ ID NO: 16 - protein, 87 aa, Pseudomonas congelans
MSITVKNNTSNIIEVAINQWDTDGDTRYSPLAAGASDKWVRKDSRGYVLSLRQGGTEKPYYVLVDSNIVVANTEVKDNDTVISPISR

SEQ ID NO: 17 - DNA, 273 bp, Pseudomonas mosselii
atgaagctcacgatcaccaatggcgcaagcacatcgattgacattgcagtgagtgcatggcgtaacgacggcaatgacagttactactcgatagctcaaggggaatctgatacctgggaccgcagcgacgcaagagggtacttgatggcggtaaaaatgaaatcccaggtaaaaacctactacatatcccaaaccagcaagatagttgttgaagacaacattgttaaagaccacggccaaacccttaacccgctatacgcagtaaacaacatg

SEQ ID NO: 18 - protein, 91 aa, Pseudomonas mosselii
MKLTITNGASTSIDIAVSAWRNDGNDSYYSIAQGESDTWDRSDARGYLMAVKMKSQVKTYYISQTSKIVVEDNIVKDHGQTLNPLYAVNNM

SEQ ID NO: 19 - DNA, 273 bp, Burkholderia pseudomallei
atggcgataagcgtcaaaaacagcgcatcgaacacggttgaagtgtcgatcaatcactggggaacggacggagacaccaagccgttcaagatggcgcccggagccagcgattcctgggatcgcaacgacctacgtggcttcgtcatgtatgtgcagctgggcgggtcggcgacgccgtactatgtgctgagcaccagtaatatcgtgatctacgacgacaaggtgacggatagcgggcaaacgctccttcccgcaaacaagcgttttggctga

SEQ ID NO: 20 - protein, 90 aa, Burkholderia pseudomallei
MAISVKNSASNTVEVSINHWGTDGDTKPFKMAPGASDSWDRNDLRGFVMYVQLGGSATPYYVLSTSNIVIYDDKVTDSGQTLLPANKRFG

SEQ ID NO: 21 - DNA, 270 bp, unknown
  encodes Hypothetical Protein from Switchgrass rhizosphere
atgagcatcacaatcacaaacggagcaagcagacagtccaaattgcagtcagcgtatgggggcgagacggtagtgacgattattattcactagagcccggcaaaggtgatacatggggacgtaatgacccaagaggttacttgatggccataaaggccaacccaagcaggtgtatattacgtcgcctttgacagtcaaattgtcatagaagacaaccttgtaaaggatcgcggccgaactatcaacccactcgcttcgaataatcaataa

SEQ ID NO: 22 - protein, 89 aa, unknown
  Hypothetical Protein from Switchgrass rhizosphere
MSITITNGASQTVQIAVSVWGRDGSDDYYSLEPGKGDTWGRNDPRGYLMAIKANPAGVYYVAFDSQIVIEDNLVKDRGRTINPLASNNQ

SEQ ID NO: 23 - DNA, 297 bp, unknown
  encodes Hypothetical Protein from Switchgrass rhizosphere
atgaacatgagcatcacagtcaccaacggggcaagcacagtagttaacgtggcaatcagtacatgggaaaaagacggcagtgacgcttactggccattagagcaaggcaaaggtgatacctggaaacgtagtgacccaaggggttacttgatggccatacaggataaatcccaaacaactgaatactacgtcacctgcaacagtgtaattgtcatcgaagacaacctcgtgaaggatcacggccggactcttaacccactcgccgcggccgggaagaaaaatgtggtaaatgcgtaa

SEQ ID NO: 24 - protein, 98 aa, unknown
  Hypothetical Protein from Switchgrass rhizosphere
MNMSITVTNGASTVVNVAISTWEKDGSDAYWPLEQGKGDTWKRSDPRGYLMAIQDKSQTTEYYVTCNSVIVIEDNLVKDHGRTLNPLAAAGKKNVVNA

SEQ ID NO: 25 - DNA, 273 bp, unknown
  Hypothetical Protein from Switchgrass rhizosphere
atgagcatcacaatcacaaacggagcaagcagaacagtccaaattgcagtcagcgtatgggggcgagacggtagtgacgattattattcactagagcccggcaaaggtgatacatggggacgtaatgacccaagaggttacttgatggccataaaaggccaaacccaagcaggtgtatattacgtcgcctttgacagtcaaattgtcatagaagacaaccttgtaaaggatcgcggccgaactatcaacccactcgcttcgaataatcaataa

SEQ ID NO: 26 - protein, 90 aa, unknown
  Hypothetical Protein from Switchgrass rhizosphere
MSITITNGASRTVQIAVSVWGRDGSDDYYSLEPGKGDTWGRNDPRGYLMAIKGQTQAGVYYVAFDSQIVIEDNLVKDRGRTINPLASNNQ

SEQ ID NO: 27 - DNA, 297 bp, Pseudomonas chlororaphis
atgaacatgagcatcacagtcacaaacggtgcaagcgcagtagttaaagtagccattagcacatggcagaaagacggcaatgacgatttctggtcattagatcaaggcgcaagcgatacctggaaacgtagcgacccaaggggctacttgatggccgtacaagacaagtcccgcacaactgaatactacgtttcctgcaacagcgccatcgttatcgaagacaatctcgtcaaagatcacggtcgaactcttaacccactcattgcggccgggcagaagaacgtggctaatgcgtaa

SEQ ID NO: 28 - protein, 98 aa, Pseudomonas chlororaphis
MNMSITVTNGASAVVKVAISTWQKDGNDDFWSLDQGASDTWKRSDPRGYLMAVQDKSRTTEYYVSCNSAIVIEDNLVKDHGRTLNPLIAAGQKNVANA

SEQ ID NO: 29 - DNA, 309 bp, Pseudomonas protegens
atggaacaatcaatccaaaaaaggaatataaatatgagcatatctatcacgaacgcaggaagcagagagatccaagttgcagtcagtacttggagcacagatagcgacatcagtgatgcctattactctctggcacccgacaagggtgacaaatggaaacgtaacgacccaagaggttacttaatgactgtaaaaggccaatcccaacaaggcgtatattacgttgcctttgacagcgaaattttcatagaagacagccttgtaaaggatcgcggaaaaactatcaccaagctcgcgctggaagttcaa

SEQ ID NO: 30 - protein, 92 aa, Pseudomonas protegens
MSISITNAGSREIQVAVSTWSTDSDISDAYYSLAPDKGDKWKRNDPRGYLMTVKGQSQQGVYYVAFDSEIFIEDSLVKDRGKTITKLALEVQ

SEQ ID NO: 31 - DNA, 288 bp, Pseudomonas chlororaphis
atgagcatcacagtcacaaacggggcaagcacagtagttaacgtggcaatcagcacatgggagaaagacggcagtgacgcttactacccattagagcaaggcaacggtgacacctggaaacgtagtgacccaaggggttacttgatggccatacaggataagtcccaaacaactgaatactacgtcacctgcaacagtgtaattgtcatcgaagacaacctcgtgaaggatcacggccgaactcttaacccagtcgctgcggccgggaagagaaaagtggcaaatgcg

SEQ ID NO: 32 - protein, 96 aa, Pseudomonas chlororaphis
MSITVTNGASTVVNVAISTWEKDGSDAYYPLEQGNGDTWKRSDPRGYLMAIQDKSQTTEYYVTCNSVIVIEDNLVKDHGRTLNPVAAAGKRKVANA

SEQ ID NO: 33 - DNA, 267 bp, Xenorhabdus bovienii
atgaagataataaataatacacaaagtaatatcatagtttctgttaataaatggggcgatgatggacaaacgggtcggtttacggtatcacctggcagaagtggatcatggaatcgcactgatgagcgcggttttgtcatggcaatactgaaaaaaggtgtacaagattccttttatattttttctgatagtgacatcaaggttttcgacagttatgttactgataatggcagaagaatcaaacccgcaactgaccgatattattag

SEQ ID NO: 34 - protein, 88 aa, Xenorhabdus bovienii
MKIINNTQSNIIVSVNKWGDDGQTGRFTVSPGRSGSWNRTDERGFVMAILKKGVQDSFYIFSDSDIKVFDSYVTDNGRRIKPATDRYY

SEQ ID NO: 35 - DNA, 282 bp, Photorhabdus luminescens
atgattattgttaaaaattcttcaaataaggtgactaaagtttcaattaataagtgggggaaagatggtaatacaggttattgggatattaatccgggagatacagcgagttggaatcgcactgatggtcgtggttttgtaatgtcaataatacgtgagaatgaggaccaaaagtcatattttgtcttagcaaatagcaacattgttatttatgataaagatgctactggttacggtaaaaatgttcaggataatggtcgttggatatatcctttaaattga

SEQ ID NO: 36 - protein, 93 aa, Photorhabdus luminescens
MIIVKNSSNKVTKVSINKWGKDGNTGYWDINPGDTASWNRTDGRGFVMSIIRENEDQKSYFVLANSNIVIYDKDATGYGKNVQDNGRWIYPLN

SEQ ID NO: 37 - DNA, 297 bp, Pseudomonas chlororaphis
atgaacatgagcatcacagtcacaaacggagcaagcgcagtagttaacgtggcaatcagcacatgggagaaagacggcagtgacgcttactacccattagagcaaggcagcggtgacacctggaaacgtagtgacccaaggggttacttgatggccatacaggataaatcccaaacaactgaatactacgtctcctgcaacagtgcaattgtcatcgaagacaacctcgtaaaggatcacggccgaactcttaacccagtcgctgcggccgggaagaaaaaagtggcaaatgcgtaa

SEQ ID NO: 38 - protein, 98 aa, Pseudomonas chlororaphis
MNMSITVTNGASAVVNVAISTWEKDGSDAYYPLEQGSGDTWKRSDPRGYLMAIQDKSQTTEYYVSCNSAIVIEDNLVKDHGRTLNPVAAAGKKKVANA

SEQ ID NO: 39 - DNA, 40 bp, Artificial Sequence
  cloning primer
atatatgcatgcatatgggtattaccgttacaaacaattc

SEQ ID NO: 40 - DNA, 31 bp, Artificial Sequence
  cloning primer
aaggatccttacgagagcggctcgatcaacc

SEQ ID NO: 41 - DNA, 39 bp, Artificial Sequence
  cloning primer
gggaaacatatgggtattactgttaaaaacaattcatcc

SEQ ID NO: 42 - DNA, 34 bp, Artificial Sequence
  cloning primer
tttcccggatccttacgagagcggcagcaatgtc

SEQ ID NO: 43 - DNA, 34 bp, Artificial Sequence
  cloning primer
ttattcatatgggtattaccgttaccaacaaatc

SEQ ID NO: 44 - DNA, 35 bp, Artificial Sequence
  cloning primer
aaggatcctcaggcgaccgggtgaatagtctcacc

SEQ ID NO: 45 - DNA, 34 bp, Artificial Sequence; identical to SEQ ID NO: 43
  cloning primer

SEQ ID NO: 46 - DNA, 35 bp, Artificial Sequence; identical to SEQ ID NO: 44
  cloning primer

SEQ ID NO: 47 - DNA, 34 bp, Artificial Sequence
  cloning primer
atcatcatatgggtattaccgttaccaacaaatc

SEQ ID NO: 48 - DNA, 34 bp, Artificial Sequence
  cloning primer
aaggatccttacgcgaccgggtgaatggtttcac

SEQ ID NO: 49 - DNA, 34 bp, Artificial Sequence; identical to SEQ ID NO: 43
  cloning primer

SEQ ID NO: 50 - DNA, 36 bp, Artificial Sequence
  cloning primer
aaggatccttacgcgaccgggtgaatggtttcaccg

SEQ ID NO: 51 - DNA, 37 bp, Artificial Sequence
  cloning primer
ttattcatatgggtattaccgttaccaacaaatcatc

SEQ ID NO: 52 - DNA, 35 bp, Artificial Sequence
  cloning primer
aaggatccttacgcgaccgggtgaatagtttcgcc

SEQ ID NO: 53 - DNA, 36 bp, Artificial Sequence
  cloning primer
gggaaacatatgagcattaccgttaaaaataacacc

SEQ ID NO: 54 - DNA, 38 bp, Artificial Sequence
  cloning primer
tttcccggatccttatctactgattggagaaataaccg

SEQ ID NO: 55 - DNA, 31 bp, Artificial Sequence
  cloning primer
atcatcatatgaagctcacgatcaccaatgg

SEQ ID NO: 56 - DNA, 34 bp, Artificial Sequence
  cloning primer
ttggatccttacatgttgtttactgcgtatagcg

SEQ ID NO: 57 - DNA, 35 bp, Artificial Sequence
  cloning primer
gagatcatatgaacatgagcatcacagtcaccaac

SEQ ID NO: 58 - DNA, 37 bp, Artificial Sequence
  cloning primer
gtcttggatccttacgcatttaccacatttttcttcc

SEQ ID NO: 59 - DNA, 36 bp, Artificial Sequence
  cloning primer
gagatcatatgaacatgagcatcacagtcacaaacg

SEQ ID NO: 60 - DNA, 37 bp, Artificial Sequence
  cloning primer
gtcttggatccttacgcattagccacgttcttctgcc

SEQ ID NO: 61 - DNA, 32 bp, Artificial Sequence
  cloning primer
aataacatatggaacaatcaatccaaaaaagg

SEQ ID NO: 62 - DNA, 34 bp, Artificial Sequence
  cloning primer
aaggatccttattgaacttccagcgcgagcttgg

SEQ ID NO: 63 - DNA, 30 bp, Artificial Sequence
  cloning primer
cagaacatatgagcatcacagtcacaaacg

SEQ ID NO: 64 - DNA, 34 bp, Artificial Sequence
  cloning primer
ttggatccttacgcatttgccacttttctcttcc

SEQ ID NO: 65 - DNA, 36 bp, Artificial Sequence; identical to SEQ ID NO: 59
  cloning primer

SEQ ID NO: 66 - DNA, 37 bp, Artificial Sequence
  cloning primer
gtcttggatccttacgcatttgccacttttttcttcc

SEQ ID NO: 67 - DNA, 33 bp, Artificial Sequence
  cloning primer
ttattcatatgagcatcacagtcacaaacggag

SEQ ID NO: 68 - DNA, 34 bp, Artificial Sequence
  cloning primer
aaggatccttacgcatttgccacttttttcttcc

SEQ ID NO: 69 - DNA, 24 bp, Artificial Sequence
  mutagenesis primer
aagcttgaattcggatccttacga

SEQ ID NO: 70 - DNA, 60 bp, Artificial Sequence
  mutagenesis primer
atcgaaggtaggcatatggcgatttctgttaaaaacaatgcgtccaaccccgtcgaagtc

SEQ ID NO: 71 - DNA, 60 bp, Artificial Sequence
  mutagenesis primer
gccatcaatcattggggtacagacggagacaccaaaccgttttccgtcgcgccgggcgcc

SEQ ID NO: 72 - DNA, 60 bp, Artificial Sequence
  mutagenesis primer
tccgatagctgggacaggaacgaccttcgtggcttcgtgatgtatgttcaactgggcggc

SEQ ID NO: 73 - DNA, 60 bp, Artificial Sequence
  mutagenesis primer
tccgcacacccttactacgttctgagcaccagcaacattgtgatctatgacgataaagtg

SEQ ID NO: 74 - DNA, 54 bp, Artificial Sequence
  mutagenesis primer
accgattcgggccaaactcttctgccgctctcgtaaggatccgaattcaagctt

SEQ ID NO: 75 - DNA, 60 bp, Artificial Sequence
  mutagenesis primer
gtctccgtctgtaccccaatgattgatggcgacttcgacggggttggacgcattgttttt

SEQ ID NO: 76 - DNA, 60 bp, Artificial Sequence
  mutagenesis primer
acgaaggtcgttcctgtcccagctatcggaggcgcccggcgcgacggaaaacggtttggt

SEQ ID NO: 77 - DNA, 60 bp, Artificial Sequence
  mutagenesis primer
ggtgctcagaacgtagtaagggtgtgcggagccgcccagttgaacatacatcacgaagcc

SEQ ID NO: 78 - DNA, 60 bp, Artificial Sequence
  mutagenesis primer
gagcggcagaagagtttggcccgaatcggtcactttatcgtcatagatcacaatgttgct

SEQ ID NO: 79 - DNA, 60 bp, Artificial Sequence
  mutagenesis primer
  misc_feature (20)..(20): S is G or C
  misc_feature (20)..(20): s is g or c
atcgaaggtaggcatatggscattagcgttaaaaacagcgcatccaacacggtcgaagtc

SEQ ID NO: 80 - DNA, 60 bp, Artificial Sequence
  mutagenesis primer
  misc_feature (1)..(1): k is g or t
  misc_feature (50)..(50): s is g or c
kcaatcaatcattggggtactgacggagacaccaaaccgtttaaaatggscccgggcgct

SEQ ID NO: 81 - DNA, 60 bp, Artificial Sequence
  mutagenesis primer
  misc_feature (7)..(7): w is a or t
  misc_feature (40)..(40): m is a or c
agcgatwcttgggacaggaacgaccttcgtggcttcgtgmtgtacgtgcaactggggggc

SEQ ID NO: 82 - DNA, 60 bp, Artificial Sequence
  mutagenesis primer
  misc_feature (1)..(1): k is g or t
  misc_feature (28)..(28): w is a or t
kcagcgactccttactacgttcttagcwctagcaatattgtcatttacgatgataaagtg

SEQ ID NO: 83 - DNA, 54 bp, Artificial Sequence
  mutagenesis primer
acagatagcggccagacactgctgccgctctcgtaaggatccgaattcaagctt

SEQ ID NO: 84 - DNA, 60 bp, Artificial Sequence
  mutagenesis primer
  misc_feature (30)..(30): m is a or c
gtctccgtcagtaccccaatgattgattgmgacttcgaccgtgttggatgcgctgttttt

SEQ ID NO: 85 - DNA, 60 bp, Artificial Sequence
  mutagenesis primer
acgaaggtcgttcctgtcccaagwatcgctagcgcccgggsccattttaaacggtttggt

SEQ ID NO: 86 - DNA, 60 bp, Artificial Sequence
  mutagenesis primer
  misc_feature (3)..(3): w is a or t
  misc_feature (30)..(30): m is a or c
  misc_feature (51)..(51): k is g or t
agwgctaagaacgtagtaaggagtcgctgmgccccccagttgcacgtacakcacgaagcc

SEQ ID NO: 87 - DNA, 60 bp, Artificial Sequence
  mutagenesis primer
gagcggcagcagtgtctggccgctatctgtcactttatcatcgtaaatgacaatattgct

SEQ ID NO: 88 - DNA, 60 bp, Artificial Sequence
  mutagenesis primer
  misc_feature (20)..(20): s is g or c
  misc_feature (26)..(26): s is g or c
  misc_feature (52)..(52): r is a or g
atcgaaggtaggcatatggscattastgttaaaaacagcgcgtccaacactrttgaagtc

SEQ ID NO: 89 - DNA, 60 bp, Artificial Sequence
  mutagenesis primer
  misc_feature (1)..(1): k is g or t
  misc_feature (20)..(20): s is g or c
  misc_feature (246)..(46): r is a or g
kcgatcaatcattggggtastgacggagacaccaagccgtttaaartggctccaggcgcc

SEQ ID NO: 90 - DNA, 60 bp, Artificial Sequence
  mutagenesis primer
  misc_feature (6)..(6): w is a or t
  misc_feature (8)..(8): s is g or c
  misc_feature (40)..(40): w is a or t
  misc_feature (46)..(46): s is g or c
agtgawasttgggacaggaacgacttacgtggcttcgtgwtgtacstgcagctgggtggc

SEQ ID NO: 91 - DNA, 60 bp, Artificial Sequence
  mutagenesis primer
  misc_feature (1)..(1): k is g or t
  misc_feature (29)..(29): s is g or c
  misc_feature (43)..(43): r is a or g
kcggctaccccttactacgttttgtcaastagcaacattgtcrtttacgatgataaagtg

SEQ ID NO: 92 - DNA, 54 bp, Artificial Sequence
  mutagenesis primer
  misc_feature (14)..(14): r is a or g
  misc_feature (19)..(19): m is a or c
accgatagtggccrgacgmttttgccgctctcgtaaggatccgaattcaagctt

SEQ ID NO: 93 - DNA, 60 bp, Artificial Sequence
  mutagenesis primer
  misc_feature (11)..(11): s is g or c
  misc_feature (30)..(30): m is a or c
  misc_feature (38)..(38): y is c or t
gtctccgtcastaccccaatgattgatcgmgacttcaayagtgttggacgcgctgttttt

SEQ ID NO: 94 - DNA, 60 bp, Artificial Sequence
  mutagenesis primer
acgtaagtcgttcctgtcccaastwtcactggcgcctggagccaytttaaacggcttggt

SEQ ID NO: 95 - DNA, 60 bp, Artificial Sequence
  mutagenesis primer
  misc_feature (2)..(2): s is g or c
  misc_feature (30)..(30): m is a or c
  misc_feature (45)..(45): s is g or c
  misc_feature (51)..(51): w is a or t
asttgacaaaacgtagtaaggggtagccgmgccacccagctgcasgtacawcacgaagcc

SEQ ID NO: 96 - DNA, 60 bp, Artificial Sequence
  mutagenesis primer
  misc_feature (12)..(12): k is g or t
  misc_feature (17)..(17): y is c or t
  misc_feature (47)..(47): y is c or t
gagcggcaaaakcgtcyggccactatcggtcactttatcatcgtaaaygacaatgttgct

SEQ ID NO: 97 - DNA, 60 bp, Artificial Sequence
  mutagenesis primer
atcgaaggtaggcatatggcaatttcagttacaaacaatgcgtccaaccccgtggaagtc

SEQ ID NO: 98 - DNA, 60 bp, Artificial Sequence
  mutagenesis primer
gccatcaatcattggggtacggacggagacaccagcttcttttccgtcgcaaacggcaag

SEQ ID NO: 99 - DNA, 60 bp, Artificial Sequence
  mutagenesis primer
caggactcttgggacaggtccgacctgcgtggcttcgtgatgtccgtgcagaagaatggc

SEQ ID NO: 100 - DNA, 60 bp, Artificial Sequence
  mutagenesis primer
gcgcaacacccttactacgttctttccaccagcaatattgtcatttatgatgacaaggtg

SEQ ID NO: 101 - DNA, 54 bp, Artificial Sequence
  mutagenesis primer
acggattccggccagacattgctgccgctctcgtaaggatccgaattcaagctt

SEQ ID NO: 102 - DNA, 60 bp, Artificial Sequence
  mutagenesis primer
gtctccgtccgtaccccaatgattgatggcgacttccacggggttggacgcattgtttgt

SEQ ID NO: 103 - DNA, 60 bp, Artificial Sequence
  mutagenesis primer
acgcaggtcggacctgtcccaagagtcctgcttgccgtttgcgacggaaaagaagctggt

SEQ ID NO: 104 - DNA, 60 bp, Artificial Sequence
  mutagenesis primer
ggtggaaagaacgtagtaagggtgttgcgcgccattcttctgcacggacatcacgaagcc

SEQ ID NO: 105 - DNA, 60 bp, Artificial Sequence
  mutagenesis primer
gagcggcagcaatgtctggccggaatccgtcaccttgtcatcataaatgacaatattgct

SEQ ID NO: 106 - DNA, 60 bp, Artificial Sequence
  mutagenesis primer
  misc_feature (32)..(32): m is a or c
  misc_feature (49)..(49): m is a or c
atcgaaggtaggcatatggcaattagtgttamaaacartgcctccaacmctgtggaagtc

SEQ ID NO: 107 - DNA, 60 bp, Artificial Sequence
  mutagenesis primer
gccatcaatcattggggtactgacggagacaccagcttctttaaggtcgccaatggcgct

SEQ ID NO: 108 - DNA, 60 bp, Artificial Sequence
  mutagenesis primer
gccatcaatcattggggtactgacggagacaccagcttctttaaggtcgccccgggcgct

SEQ ID NO: 109 - DNA, 60 bp, Artificial Sequence
  mutagenesis primer
gccatcaatcattggggtactgacggagacaccagcccatttaaggtcgccaatggcgct

SEQ ID NO: 110 - DNA, 60 bp, Artificial Sequence
  mutagenesis primer
gccatcaatcattggggtactgacggagacaccagcccatttaaggtcgccccgggcgct

SEQ ID NO: 111 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaattaaatggc

SEQ ID NO: 112 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaattagggggc

SEQ ID NO: 113 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaaaaaaatggc

SEQ ID NO: 114 - DNA, 60 bp, Artificial Sequence
  mutagenesis primer
  misc_feature (8)..(8): s is g or c
  misc_feature (20)..(20): r is a or g
  misc_feature (26)..(26): y is c or t
  misc_feature (44)..(44): m is a or c
tcggatasctgggacaggarcgactyacgtggcttcgtgatgtmtgtacaaaaagggggc

SEQ ID NO: 115 - DNA, 60 bp, Artificial Sequence
  mutagenesis primer
tctgcacacccttactacgttcwgtctaccagcaawattgwaatckacracracgccgtg

SEQ ID NO: 116 - DNA, 60 bp, Artificial Sequence
  mutagenesis primer
tctcagcacccttactacgttcwgtctaccagcaawattgwaatckacracracgccgtg

SEQ ID NO: 117 - DNA, 54 bp, Artificial Sequence
  mutagenesis primer
  misc_feature (2)..(2): m is a or c
amagattctggccagacccttttaccgctctcgtaaggatccgaattcaagctt

SEQ ID NO: 118 - DNA, 54 bp, Artificial Sequence
  mutagenesis primer
  misc_feature (2)..(2): m is a or c
amagatcaaggccagacccttttaccgctctcgtaaggatccgaattcaagctt

SEQ ID NO: 119 - DNA, 60 bp, Artificial Sequence
  mutagenesis primer
  misc_feature (42)..(42): k is g or t
  misc_feature (53)..(53): y is c or t
  misc_feature (59)..(59): k is g or t
gtctccgtcagtaccccaatgattgatggcgacttccacagkgttggaggcaytgtttkt

SEQ ID NO: 120 - DNA, 60 bp, Artificial Sequence
  mutagenesis primer
  misc_feature (5)..(5): r is a or g
  misc_feature (11)..(11): y is c or t
  misc_feature (23)..(23): s is g or c
acgtragtcgytcctgtcccagstatccgaagcgccattggcgaccttaaagaagctggt

SEQ ID NO: 121 - DNA, 60 bp, Artificial Sequence
  mutagenesis primer
  misc_feature (5)..(5): r is a or g
  misc_feature (11)..(11): y is c ot t
  misc_feature (23)..(23): s is g or c
acgtragtcgytcctgtcccagstatccgaagcgcccggggcgaccttaaagaagctggt

SEQ ID NO: 122 - DNA, 60 bp, Artificial Sequence
  mutagenesis primer
  misc_feature (5)..(5): r is a or g
  misc_feature (11)..(11): y is c or t
  misc_feature (23)..(23): s is g or c
acgtragtcgytcctgtcccagstatccgaagcgccattggcgaccttaaatgggctggt

SEQ ID NO: 123 - DNA, 60 bp, Artificial Sequence
  mutagenesis primer
  misc_feature (5)..(5): r is a or g
  misc_feature (11)..(11): y is c or t
  misc_feature (23)..(23): s is g or c
acgtragtcgytcctgtcccagstatccgaagcgcccggggcgaccttaaatgggctggt

SEQ ID NO: 124 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccatttaattgtacakacatcacgaagcc

SEQ ID NO: 125 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccatttaattgtacakacatcacgaagcc

SEQ ID NO: 126 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccccctaattgtacakacatcacgaagcc

SEQ ID NO: 127 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccccctaattgtacakacatcacgaagcc

SEQ ID NO: 128 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccatttttttgtacakacatcacgaagcc

SEQ ID NO: 129 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccatttttttgtacakacatcacgaagcc

SEQ ID NO: 130 - DNA, 60 bp, Artificial Sequence
  mutagenesis primer
  misc_feature (8)..(8): w is a or t
  misc_feature (47)..(47): k is g or t
ggtagacwgaacgtagtaagggtgtgcagagccccctttttgtacakacatcacgaagcc

SEQ ID NO: 131 - DNA, 60 bp, Artificial Sequence
  mutagenesis primer
  misc_feature (8)..(8): w is a or t
  misc_feature (47)..(47): k is g or t
ggtagacwgaacgtagtaagggtgctgagagccccctttttgtacakacatcacgaagcc

SEQ ID NO: 132 - DNA, 60 bp, Artificial Sequence
  mutagenesis primer
  misc_feature (29)..(29): k is g or t
  misc_feature (39)..(39): y is c or t
  misc_feature (42)..(42): y is c or t
  misc_feature (45)..(45): m is a or c
  misc_feature (50)..(50): w is a or t
  misc_feature (55)..(55): w is a or t
gagcggtaaaagggtctggccagaatctktcacggcgtygtygtmgattwcaatwttgct

SEQ ID NO: 133 - DNA, 60 bp, Artificial Sequence
  mutagenesis primer
  misc_feature (29)..(29): k is g or t
  misc_feature (39)..(39): y is c or t
  misc_feature (42)..(42): y is c or t
  misc_feature (45)..(45): m is a or c
  misc_feature (50)..(50): w is a or t
  misc_feature (55)..(55): w is a or t
gagcggtaaaagggtctggccttgatctktcacggcgtygtygtmgattwcaatwttgct

SEQ ID NO: 134 - DNA, 60 bp, Artificial Sequence
  mutagenesis primer
atcgaaggtaggcatatgggtattagtgttaaaaacagcgcgtccaacacggtggaagtc

SEQ ID NO: 135 - DNA, 60 bp, Artificial Sequence
  mutagenesis primer
gccatcaatcattggggtacggacggagacaccagcccgtttaaagtcggtccgggcgcc

SEQ ID NO: 136 - DNA, 60 bp, Artificial Sequence
  mutagenesis primer
agtgatacctgggacaggaacgaccttcgtggcttcgtgctttatgtacagttgggcggc

SEQ ID NO: 137 - DNA, 60 bp, Artificial Sequence
  mutagenesis primer
gcggcgcacccttactacgttctgtctagcagcaacattgttatctatgatgataaggtg

SEQ ID NO: 138 - DNA, 54 bp, Artificial Sequence
  mutagenesis primer
actgattcgggccagaccctgcttccgctctcgtaaggatccgaattcaagctt

SEQ ID NO: 139 - DNA, 60 bp, Artificial Sequence
  mutagenesis primer
gtctccgtccgtaccccaatgattgatggcgacttccaccgtgttggacgcgctgttttt

SEQ ID NO: 140 - DNA, 60 bp, Artificial Sequence
  mutagenesis primer
acgaaggtcgttcctgtcccaggtatcactggcgcccggaccgactttaaacgggctggt

SEQ ID NO: 141 - DNA, 60 bp, Artificial Sequence
  mutagenesis primer
gctagacagaacgtagtaagggtgcgccgcgccgcccaactgtacataaagcacgaagcc

SEQ ID NO: 142 - DNA, 60 bp, Artificial Sequence
  mutagenesis primer
gagcggaagcagggtctggcccgaatcagtcaccttatcatcatagataacaatgttgct

SEQ ID NO: 143 - DNA, 75 bp, Artificial Sequence
  mutagenesis primer
  misc_feature (20)..(20): s is g or c
  misc_feature (32)..(32): r is a or g
  misc_feature (34)..(34): k is g or t
  misc_feature (46)..(46): r is a or g
  misc_feature (55)..(55): k is g or t
ggtaggcatatggccattascgttaaaaacarckcttccaacacgrttgaagtckctatcaatcattggggtact

SEQ ID NO: 144 - DNA, 42 bp, Artificial Sequence
  mutagenesis primer
  misc_feature (4)..(4): r is a or g
  misc_feature (24)..(24): w is a or t
  misc_feature (26)..(26): s is g or c
aaartggccccgggcgctagcgawasctgggacaggaacgac

SEQ ID NO: 145 - DNA, 45 bp, Artificial Sequence
  mutagenesis primer
  misc_feature (16)..(16): m is a or c
  misc_feature (25)..(25): m is a or c
cttcgtggcttcgtgmtgtacgtgmagctggggggctcagcgact

SEQ ID NO: 146 - DNA, 75 bp, Artificial Sequence
  mutagenesis primer
  misc_feature (21)..(21): m is a or c
  misc_feature (30)..(30): y is c or t
  misc_feature (42)..(42): m is a or c
  misc_feature (44)..(44): y is c or t
  misc_feature (56)..(56): s is g or c
agtaccccaatgattgatagmgacttcaaycgtgttggaagmgytgtttttaacgstaatggccatatgcctacc

SEQ ID NO: 147 - DNA, 42 bp, Artificial Sequence
  mutagenesis primer
  misc_feature (17)..(17): s is g or c
  misc_feature (19)..(19): w is a or t
  misc_feature (39)..(39): y is c or t
gtcgttcctgtcccagstwtcgctagcgcccggggccayttt

SEQ ID NO: 148 - DNA, 45 bp, Artificial Sequence
  mutagenesis primer
  misc_feature (21)..(21): k is g or t
  misc_feature (30)..(30): k is g or t
agtcgctgagccccccagctkcacgtacakcacgaagccacgaag

SEQ ID NO: 149 - DNA, 75 bp, Artificial Sequence
  mutagenesis primer
  misc_feature (20)..(20): s is g or c
  misc_feature (32)..(32): r is a or g
  misc_feature (34)..(34): k is g or t
  misc_feature (46)..(46): r is a or g
  misc_feature (55)..(55): k is g or t
ggtaggcatatggcaattastgttacaaacartkcgtccaaccccrttgaagtckcgatcaatcattggggtacg

SEQ ID NO: 150 - DNA, 39 bp, Artificial Sequence
  mutagenesis primer
  misc_feature (21)..(21): w is a or t
  misc_feature (23)..(23): s is g or c
gtcgcaaacggcaagcaggawasttgggacaggtccgac

SEQ ID NO: 151 - DNA, 45 bp, Artificial Sequence
  mutagenesis primer
  misc_feature (16)..(16): w is a or t
  misc_feature (25)..(25): m is a or c
ctgcgtggcttcgtgwtgtccgtgmagaagaatggcgcgcaacac

SEQ ID NO: 152 - DNA, 57 bp, Artificial Sequence
  mutagenesis primer
  misc_feature (22)..(22): m is a or c
  misc_feature (35)..(35): r is a or g
gtgacggattccggccagttamttttgccgttaarttaaggatccgaattcaagctt

SEQ ID NO: 153 - DNA, 57 bp, Artificial Sequence
  mutagenesis primer
  misc_feature (22)..(22): m is a or c
  misc_feature (35)..(35): r is a or g
gtgacggattccggccagttamttttgccggctarttaaggatccgaattcaagctt

SEQ ID NO: 154 - DNA, 57 bp, Artificial Sequence
  mutagenesis primer
  misc_feature (22)..(22): m is a or c
  misc_feature (35)..(35): r is a or g
gtgacggattccggccagttamttgaaccgttaarttaaggatccgaattcaagctt

SEQ ID NO: 155 - DNA, 57 bp, Artificial Sequence
  mutagenesis primer
  misc_feature (22)..(22): m is a or c
  misc_feature (35)..(35): r is a or g
gtgacggattccggccagttamttgaaccggctarttaaggatccgaattcaagctt

SEQ ID NO: 156 - DNA, 57 bp, Artificial Sequence
  mutagenesis primer
  misc_feature (22)..(22): m is a or c
  misc_feature (35)..(35): r is a or g
gtgacggattccggccagacgmttttgccgttaarttaaggatccgaattcaagctt

SEQ ID NO: 157 - DNA, 57 bp, Artificial Sequence
  mutagenesis primer
  misc_feature (22)..(22): m is a or c
  misc_feature (35)..(35): r is a or g
gtgacggattccggccagacgmttttgccggctarttaaggatccgaattcaagctt

SEQ ID NO: 158 - DNA, 57 bp, Artificial Sequence
  mutagenesis primer
  misc_feature (22)..(22): m is a or c
  misc_feature (35)..(35): r is a or g
gtgacggattccggccagacgmttgaaccgttaarttaaggatccgaattcaagctt

SEQ ID NO: 159 - DNA, 57 bp, Artificial Sequence
  mutagenesis primer
  misc_feature (22)..(22): m is a or c
  misc_feature (35)..(35): r is a or g
gtgacggattccggccagacgmttgaaccggctarttaaggatccgaattcaagctt

SEQ ID NO: 160 - DNA, 75 bp, Artificial Sequence
  mutagenesis primer
  misc_feature (21)..(21): m is a or c
  misc_feature (30)..(30): y is c or t
  misc_feature (42)..(42): m is a or c
  misc_feature (44)..(44): y is c or t
  misc_feature (56)..(56): s is g or c
cgtaccccaatgattgatcgmgacttcaayggggttggacgmaytgtttgtaacastaattgccatatgcctacc

SEQ ID NO: 161 - DNA, 39 bp, Artificial Sequence
  mutagenesis primer
  misc_feature (17)..(17): s is g or c
  misc_feature (19)..(19): w is a or t
gtcggacctgtcccaastwtcctgcttgccgtttgcgac

SEQ ID NO: 162 - DNA, 45 bp, Artificial Sequence
  mutagenesis primer
  misc_feature (21)..(21): k is g or t
  misc_feature (390)..(30): w is a or t
gtgttgcgcgccattcttctkcacggacawcacgaagccacgcag

SEQ ID NO: 163 - DNA, 57 bp, Artificial Sequence
  mutagenesis primer
  misc_feature (23)..(23): y is c or t
  misc_feature (36)..(36): k is g or t
aagcttgaattcggatccttaayttaacggcaaaaktaactggccggaatccgtcac

SEQ ID NO: 164 - DNA, 57 bp, Artificial Sequence
  mutagenesis primer
  misc_feature (23)..(23): y is c or t
  misc_feature (36)..(36): k is g or t
aagcttgaattcggatccttaaytagccggcaaaaktaactggccggaatccgtcac

SEQ ID NO: 165 - DNA, 57 bp, Artificial Sequence
  mutagenesis primer
  misc_feature (23)..(23): y is c or t
  misc_feature (36)..(36): k is g or t
aagcttgaattcggatccttaayttaacggttcaaktaactggccggaatccgtcac

SEQ ID NO: 166 - DNA, 57 bp, Artificial Sequence
  mutagenesis primer
  misc_feature (23)..(23): y is c or t
  misc_feature (36)..(36): k is g or t
aagcttgaattcggatccttaaytagccggttcaaktaactggccggaatccgtcac

SEQ ID NO: 167 - DNA, 57 bp, Artificial Sequence
  mutagenesis primer
  misc_feature (23)..(23): y is c or t
  misc_feature (36)..(36): k is g or t
aagcttgaattcggatccttaayttaacggcaaaakcgtctggccggaatccgtcac

SEQ ID NO: 168 - DNA, 57 bp, Artificial Sequence
  mutagenesis primer
  misc_feature (23)..(23): y is c or t
  misc_feature (36)..(36): k is g or t
aagcttgaattcggatccttaaytagccggcaaaakcgtctggccggaatccgtcac

SEQ ID NO: 169 - DNA, 57 bp, Artificial Sequence
  mutagenesis primer
  misc_feature (23)..(23): y is c or t
  misc_feature (36)..(36): k is g or t
aagcttgaattcggatccttaayttaacggttcaakcgtctggccggaatccgtcac

SEQ ID NO: 170 - DNA, 57 bp, Artificial Sequence
  mutagenesis primer
  misc_feature (23)..(23): y is c or t
  misc_feature (36)..(36): k is g or t
aagcttgaattcggatccttaaytagccggttcaakcgtctggccggaatccgtcac

SEQ ID NO: 171 - DNA, 69 bp, Artificial Sequence
  mutagenesis primer
  misc_feature (24)..(24): s is g or c
  misc_feature (35)..(35): y is c or t
accgttacaaacaattcgtccaasaaaatcgaagyggccatcaataaatggggtagcgacggagacacc

SEQ ID NO: 172 - DNA, 69 bp, Artificial Sequence
  mutagenesis primer
  misc_feature (24)..(24): s is g or c
  misc_feature (35)..(35): y is c or t
accgttacaaacaattcgtccaasaaaatcgaagyggccatcaatcactggggtagcgacggagacacc

SEQ ID NO: 173 - DNA, 69 bp, Artificial Sequence
  mutagenesis primer
  misc_feature (24)..(24): s is g or c
  misc_feature (35)..(35): y is c or t
accgttacaaacaattcgtccaasccgatcgaagyggccatcaataaatggggtagcgacggagacacc

SEQ ID NO: 174 - DNA, 69 bp, Artificial Sequence
  mutagenesis primer
  misc_feature (24)..(24): s is g or c
  misc_feature (35)..(35): y is c or t
accgttacaaacaattcgtccaasccgatcgaagyggccatcaatcactggggtagcgacggagacacc

SEQ ID NO: 175 - DNA, 78 bp, Artificial Sequence
  mutagenesis primer
  misc_feature (31)..(31): r is a or g
  misc_feature (34)..(34): r is a or g
  misc_feature (38)..(38): r is a or g
  misc_feature (41)..(41): r is a or g
  misc_feature (55)..(55): w is a or t
tggggtagcgacggagacaccagcttctttrgcrttgrtarcggcaagcaggaawcctgggacaggtccgacagccgt

SEQ ID NO: 176 - DNA, 57 bp, Artificial Sequence
  mutagenesis primer
ggcttcgtgctttccctgaagaagaatggcgcgcaacacccttactacgttcaggcc

SEQ ID NO: 177 - DNA, 57 bp, Artificial Sequence
  mutagenesis primer
ggcttcgtgctttccctgaagaagaatggcgcgcaagcaccttactacgttcaggcc

SEQ ID NO: 178 - DNA, 57 bp, Artificial Sequence
  mutagenesis primer
ggcttcgtgctttccctgaagcgcaatggcgcgcaacacccttactacgttcaggcc

SEQ ID NO: 179 - DNA, 57 bp, Artificial Sequence
  mutagenesis primer
ggcttcgtgctttccctgaagcgcaatggcgcgcaagcaccttactacgttcaggcc

SEQ ID NO: 180 - DNA, 63 bp, Artificial Sequence
  mutagenesis primer
  misc_feature (19)..(19): w is a or t
  misc_feature (34)..(34): r is a or g
  misc_feature (38)..(38): m is a or c
  misc_feature (46)..(46): r is a or g
ccttactacgttcaggccwccagcaaaattgaarttgamaacaacrccgtgaaagatcagggc

SEQ ID NO: 181 - DNA, 55 bp, Artificial Sequence
  mutagenesis primer
  misc_feature (31)..(31): s is g or c
  misc_feature (34)..(34): k is g or t
gtgaaagatcagggcgaattgatcgagccgstgkcttaaggatccgaattcaagc

SEQ ID NO: 182 - DNA, 55 bp, Artificial Sequence
  mutagenesis primer
  misc_feature (31)..(31): s is g or c
  misc_feature (34)..(34): k is g or t
gtgaaagatcagggcgaattgatccacccgstgkcttaaggatccgaattcaagc

SEQ ID NO: 183 - DNA, 55 bp, Artificial Sequence
  mutagenesis primer
  misc_feature (31)..(31): s is g or c
  misc_feature (34)..(34): k is g or t
gtgaaagatcagggccgtttgatcgagccgstgkcttaaggatccgaattcaagc

SEQ ID NO: 184 - DNA, 55 bp, Artificial Sequence
  mutagenesis primer
  misc_feature (31)..(31): s is g or c
  misc_feature (34)..(34): k is g or t
gtgaaagatcagggccgtttgatccacccgstgkcttaaggatccgaattcaagc

SEQ ID NO: 185 - DNA, 69 bp, Artificial Sequence
  mutagenesis primer
accgttacaaacaattcgtccaagaagatcgaagctgccatcaataaatggggtagcgacggagacacc

SEQ ID NO: 186 - DNA, 78 bp, Artificial Sequence
  mutagenesis primer
tggggtagcgacggagacaccagcttctttggcattgacagcggcaagcaggaatcttgggacaggtccgacagccgt

SEQ ID NO: 187 - DNA, 57 bp, Artificial Sequence
  mutagenesis primer
ggcttcgtgctttccctgaagcgtaatggcgcgcaagctccttactacgttcaggcc

SEQ ID NO: 188 - DNA, 63 bp, Artificial Sequence
  mutagenesis primer
ccttactacgttcaggccactagcaaaattgaaattgaaaacaacacggtgaaagatcagggc

SEQ ID NO: 189 - DNA, 55 bp, Artificial Sequence
  mutagenesis primer
gtgaaagatcagggcgaattgatccacccggtcgcataaggatccgaattcaagc

SEQ ID NO: 190 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
atatgggtattaccgttacannkaattcgtccaaccccatcga

SEQ ID NO: 191 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
tcgatggggttggacgaattmnntgtaacggtaatacccatat

SEQ ID NO: 192 - DNA, 43 bp, Artificial Sequence
  mutagenesis primer
  misc_feature (22)..(22): n is g, a, c or t
  misc_feature (23)..(23): n is g, a, c or t
  misc_feature (24)..(24): k is g or t
atgggtattaccgttacaaacnnktcgtccaaccccatcgaag

SEQ ID NO: 193 - DNA, 43 bp, Artificial Sequence
  mutagenesis primer
  misc_feature (20)..(20): m is a or c
  misc_feature (21)..(21): n is g, a, c or t
  misc_feature (22)..(22): n is g, a, c or t
cttcgatggggttggacgamnngtttgtaacggtaatacccat

SEQ ID NO: 194 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
ttaccgttacaaacaattcgnnkaaccccatcgaagtcgccat

SEQ ID NO: 195 - DNA, 43 bp, Artificial Sequence
  mutagenesis primer
  misc_feature (21)..(21): m is a or c
  misc_feature (22)..(22): n is g, a, c or t
  misc_feature (22)..(23): n is g, a, c or t
atggcgacttcgatggggttmnncgaattgtttgtaacggtaa

SEQ ID NO: 196 - DNA, 48 bp, Artificial Sequence
  mutagenesis primer
  misc_feature (28)..(28): n is g, a, c or t
  misc_feature (29)..(29): n is g, a, c or t
  misc_feature (30)..(30): k is g or t
ggtattaccgttacaaacaattcgtccnnkcccatcgaagtcgccatc

SEQ ID NO: 197 - DNA, 48 bp, Artificial Sequence
  mutagenesis primer
  misc_feature (19)..(19): m is a or c
  misc_feature (20)..(20): n is g, a, c or t
  misc_feature (21)..(21): n is g, a, c or t
gatggcgacttcgatgggmnnggacgaattgtttgtaacggtaatacc

SEQ ID NO: 198 - DNA, 44 bp, Artificial Sequence
  mutagenesis primer
  misc_feature (23)..(23): n is g, a, c or t
  misc_feature (24)..(24): n is g, a, c or t
  misc_feature (25)..(25): k is g or t
cgttacaaacaattcgtccaacnnkatcgaagtcgccatcaatc

SEQ ID NO: 199 - DNA, 44 bp, Artificial Sequence
  mutagenesis primer
  misc_feature (20)..(20): m is a or c
  misc_feature (21)..(21): n is g, a, c or t
  misc_feature (22)..(22): n is g, a, c or t
gattgatggcgacttcgatmnngttggacgaattgtttgtaacg

SEQ ID NO: 200 - DNA, 46 bp, Artificial Sequence
  mutagenesis primer
  misc_feature (23)..(23): n is g, a, c or t
  misc_feature (24)..(24): n is g, a, c or t
  misc_feature (25)..(25): k is g or t
caattcgtccaaccccatcgaannkgccatcaatcattggggtagc

SEQ ID NO: 201 - DNA, 46 bp, Artificial Sequence
  mutagenesis primer
  misc_feature (22)..(22): m is a or c
  misc_feature (23)..(23): n is g, a, c or t
  misc_feature (24)..(24): n is g, a, c or t
gctaccccaatgattgatggcmnnttcgatggggttggacgaattg

SEQ ID NO: 202 - DNA, 45 bp, Artificial Sequence
  mutagenesis primer
  misc_feature (21)..(21): n is g, a, c or t
  misc_feature (22)..(22): n is g, a, c or t
  misc_feature (23)..(23): k is g or t
cgtccaaccccatcgaagtcnnkatcaatcattggggtagcgacg

SEQ ID NO: 203 - DNA, 45 bp, Artificial Sequence
  mutagenesis primer
  misc_feature (23)..(23): m is a or c
  misc_feature (24)..(24): n is g, a, c or t
  misc_feature (25)..(25): n is g, a, c or t
cgtcgctaccccaatgattgatmnngacttcgatggggttggacg

SEQ ID NO: 204 - DNA, 44 bp, Artificial Sequence
  mutagenesis primer
  misc_feature (21)..(21): n is g, a, c or t
  misc_feature (22)..(22): n is g, a, c or t
  misc_feature (23)..(23): k is g or t
ccatcgaagtcgccatcaatnnktggggtagcgacggagacacc

SEQ ID NO: 205 - DNA, 44 bp, Artificial Sequence
  mutagenesis primer
  misc_feature (22)..(22): m is a or c
  misc_feature (23)..(23): n is g, a, c or t
  misc_feature (24)..(24): n is g, a, c or t
ggtgtctccgtcgctaccccamnnattgatggcgacttcgatgg

SEQ ID NO: 206 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
tcgaagtcgccatcaatcatnnkggtagcgacggagacaccag

SEQ ID NO: 207 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
ctggtgtctccgtcgctaccmnnatgattgatggcgacttcga

SEQ ID NO: 208 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
ccatcaatcattggggtagcnnkggagacaccagcttcttttc

SEQ ID NO: 209 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
gaaaagaagctggtgtctccmnngctaccccaatgattgatgg

SEQ ID NO: 210 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
tcaatcattggggtagcgacnnkgacaccagcttcttttccgt

SEQ ID NO: 211 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
acggaaaagaagctggtgtcmnngtcgctaccccaatgattga

SEQ ID NO: 212 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
ggggtagcgacggagacaccnnkttcttttccgtcggtaacgg

SEQ ID NO: 213 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
ccgttaccgacggaaaagaamnnggtgtctccgtcgctacccc

SEQ ID NO: 214 - DNA, 44 bp, Artificial Sequence
  mutagenesis primer
  misc_feature (23)..(23): n is g, a, c or t
  misc_feature (24)..(24): n is g, a, c or t
  misc_feature (25)..(25): k is g or t
cgacggagacaccagcttctttnnkgtcggtaacggcaagcagg

SEQ ID NO: 215 - DNA, 44 bp, Artificial Sequence
  mutagenesis primer
  misc_feature (20)..(20): m is a or c
  misc_feature (21)..(21): n is g, a, c or t
  misc_feature (22)..(22): n is g, a, c or t
cctgcttgccgttaccgacmnnaaagaagctggtgtctccgtcg

SEQ ID NO: 216 - DNA, 45 bp, Artificial Sequence
  mutagenesis primer
  misc_feature (22)..(22): n is g, a, c or t
  misc_feature (23)..(23): n is g, a, c or t
  misc_feature (24)..(24): k is g or t
ggagacaccagcttcttttccnnkggtaacggcaagcaggaaacc

SEQ ID NO: 217 - DNA, 45 bp, Artificial Sequence
  mutagenesis primer
  misc_feature (22)..(22): m is a or c
  misc_feature (23)..(23): n is g, a, c or t
  misc_feature (24)..(24): n is g, a, c or t
ggtttcctgcttgccgttaccmnnggaaaagaagctggtgtctcc

SEQ ID NO: 218 - DNA, 48 bp, Artificial Sequence
  mutagenesis primer
  misc_feature (25)..(25): n is g, a, c or t
  misc_feature (26)..(26): n is g, a, c or t
  misc_feature (27)..(27): k is g or t
ggagacaccagcttcttttccgtcnnkaacggcaagcaggaaacctgg

SEQ ID NO: 219 - DNA, 48 bp, Artificial Sequence
  mutagenesis primer
  misc_feature (22)..(22): m is a or c
  misc_feature (23)..(23): n is g, a, c or t
  misc_feature (24)..(24): n is g, a, c or t
ccaggtttcctgcttgccgttmnngacggaaaagaagctggtgtctcc

SEQ ID NO: 220 - DNA, 42 bp, Artificial Sequence
  mutagenesis primer
  misc_feature (21)..(21): n is g, a, c or t
  misc_feature (22)..(22): n is g, a, c or t
  misc_feature (23)..(23): k is g or t
ccagcttcttttccgtcggtnnkggcaagcaggaaacctggg

SEQ ID NO: 221 - DNA, 42 bp, Artificial Sequence
  mutagenesis primer
  misc_feature (20)..(20): m is a or c
  misc_feature (21)..(21): n is g, a, c or t
  misc_feature (22)..(22): n is g, a, c or t
cccaggtttcctgcttgccmnnaccgacggaaaagaagctgg

SEQ ID NO: 222 - DNA, 43 bp, Artificial Sequence
  mutagenesis primer
  misc_feature (21)..(21): n is g, a, c or t
  misc_feature (22)..(22): n is g, a, c or t
  misc_feature (23)..(23): k is g or t
gcttcttttccgtcggtaacnnkaagcaggaaacctgggacag

SEQ ID NO: 223 - DNA, 43 bp, Artificial Sequence
  mutagenesis primer
  misc_feature (21)..(21): m is a or c
  misc_feature (22)..(22): n is g, a, c or t
  misc_feature (23)..(23): n is g, a, c or t
ctgtcccaggtttcctgcttmnngttaccgacggaaaagaagc

SEQ ID NO: 224 - DNA, 44 bp, Artificial Sequence
  mutagenesis primer
  misc_feature (21)..(21): n is g, a, c or t
  misc_feature (22)..(22): n is g, a, c or t
  misc_feature (23)..(23): k is g or t
gcttcgtgctttccctgaagnnkaatggcgcgcaacacccttac

SEQ ID NO: 225 - DNA, 44 bp, Artificial Sequence
  mutagenesis primer
  misc_feature (22)..(22): m is a or c
  misc_feature (23)..(23): n is g, a, c or t
  misc_feature (24)..(24): n is g, a, c or t
gtaagggtgttgcgcgccattmnncttcagggaaagcacgaagc

SEQ ID NO: 226 - DNA, 46 bp, Artificial Sequence
  mutagenesis primer
  misc_feature (23)..(23): n is g, a, c or t
  misc_feature (24)..(24): n is g, a, c or t
  misc_feature (25)..(25): k is g or t
gctttccctgaagaagaatggcnnkcaacacccttactacgttcag

SEQ ID NO: 227 - DNA, 46 bp, Artificial Sequence
  mutagenesis primer
  misc_feature (22)..(22): m is a or c
  misc_feature (23)..(23): n is g, a, c or t
  misc_feature (24)..(24): n is g, a, c or t
ctgaacgtagtaagggtgttgmnngccattcttcttcagggaaagc

SEQ ID NO: 228 - DNA, 44 bp, Artificial Sequence
  mutagenesis primer
  misc_feature (22)..(22): n is g, a, c or t
  misc_feature (23)..(23): n is g, a, c or t
  misc_feature (24)..(24): k is g ot t
ctgaagaagaatggcgcgcaannkccttactacgttcaggccag

SEQ ID NO: 229 - DNA, 44 bp, Artificial Sequence
  mutagenesis primer
  misc_feature (21)..(21): m is a or c
  misc_feature (22)..(22): n is g, a, c or t
  misc_feature (23)..(23): n is g, a, c or t
ctggcctgaacgtagtaaggmnnttgcgcgccattcttcttcag

SEQ ID NO: 230 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
agaatggcgcgcaacaccctnnktacgttcaggccagcagcaa

SEQ ID NO: 231 - DNA, 44 bp, Artificial Sequence
  mutagenesis primer
  misc_feature (21)..(21): m is a or c
  misc_feature (22)..(22): n is g, a, t or c
  misc_feature (23)..(23): n is g, a, t or c
  misc_feature (44)..(44): n is a, c, g, or t
ttgctgctggcctgaacgtamnnagggtgttgcgcgccattctn

SEQ ID NO: 232 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
atggcgcgcaacacccttacnnkgttcaggccagcagcaaaat

SEQ ID NO: 233 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
attttgctgctggcctgaacmnngtaagggtgttgcgcgccat

SEQ ID NO: 234 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
cacccttactacgttcaggccnnkagcaaaattgaagtcgacaac

SEQ ID NO: 235 - DNA, 45 bp, Artificial Sequence
  mutagenesis primer
  misc_feature (22)..(22): m is a or c
  misc_feature (23)..(23): n is g, a, t or c
  misc_feature (24)..(24): n is g, a, t or c
gttgtcgacttcaattttgctmnnggcctgaacgtagtaagggtg

SEQ ID NO: 236 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
cttactacgttcaggccagcnnkaaaattgaagtcgacaacaa

SEQ ID NO: 237 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
ttgttgtcgacttcaattttmnngctggcctgaacgtagtaag

SEQ ID NO: 238 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
acgttcaggccagcagcaaannkgaagtcgacaacaacgccgt

SEQ ID NO: 239 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
acggcgttgttgtcgacttcmnntttgctgctggcctgaacgt

SEQ ID NO: 240 - DNA, 41 bp, Artificial Sequence
  mutagenesis primer
  misc_feature (20)..(20): n is g, a, t or c
  misc_feature (21)..(21): n is g, a, t or c
  misc_feature (22)..(22): k is g or t
ggccagcagcaaaattgaannkgacaacaacgccgtgaaag

SEQ ID NO: 241 - DNA, 41 bp, Artificial Sequence
  mutagenesis primer
  misc_feature (20)..(20): m is a or c
  misc_feature (21)..(21): n is g, a, t or c
  misc_feature (22)..(22): n is g, a, t or c
ctttcacggcgttgttgtcmnnttcaattttgctgctggcc

SEQ ID NO: 242 - DNA, 44 bp, Artificial Sequence
  mutagenesis primer
  misc_feature (21)..(21): n is g, a, t or c
  misc_feature (22)..(22): n is g, a, t or c
  misc_feature (23)..(23): k is g or t
ccagcagcaaaattgaagtcnnkaacaacgccgtgaaagatcag

SEQ ID NO: 243 - DNA, 44 bp, Artificial Sequence
  mutagenesis primer
  misc_feature (22)..(22): m is a or c
  misc_feature (23)..(23): n is g, a, t or c
  misc_feature (24)..(24): n is g, a, t or c
ctgatctttcacggcgttgttmnngacttcaattttgctgctgg

SEQ ID NO: 244 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
gcaaaattgaagtcgacaacnnkgccgtgaaagatcagggccg

SEQ ID NO: 245 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
cggccctgatctttcacggcmnngttgtcgacttcaattttgc

SEQ ID NO: 246 - DNA, 47 bp, Artificial Sequence
  mutagenesis primer
  misc_feature (24)..(24): n is g, a, t or c
  misc_feature (25)..(25): n is g, a, t or c
  misc_feature (26)..(26): k is g or t
gcaaaattgaagtcgacaacaacnnkgtgaaagatcagggccggttg

SEQ ID NO: 247 - DNA, 47 bp, Artificial Sequence
  mutagenesis primer
  misc_feature (22)..(22): m is a or c
  misc_feature (23)..(23): n is g, a, t or c
  misc_feature (24)..(24): n is g, a, t or c
caaccggccctgatctttcacmnngttgttgtcgacttcaattttgc

SEQ ID NO: 248 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
ttgaagtcgacaacaacgccnnkaaagatcagggccggttgat

SEQ ID NO: 249 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
atcaaccggccctgatctttmnnggcgttgttgtcgacttcaa

SEQ ID NO: 250 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
tcgacaacaacgccgtgaaannkcagggccggttgatcgagcc

SEQ ID NO: 251 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
ggctcgatcaaccggccctgmnntttcacggcgttgttgtcga

SEQ ID NO: 252 - DNA, 42 bp, Artificial Sequence
  mutagenesis primer
  misc_feature (22)..(22): n is g, a, t or c
  misc_feature (23)..(23): n is g, a, t or c
  misc_feature (24)..(24): k is g or t
gacaacaacgccgtgaaagatnnkggccggttgatcgagccg

SEQ ID NO: 253 - DNA, 42 bp, Artificial Sequence
  mutagenesis primer
  misc_feature (19)..(19): m is a or c
  misc_feature (20)..(20): n is g, a, t or c
  misc_feature (21)..(21): n is g, a, t or c
cggctcgatcaaccggccmnnatctttcacggcgttgttgtc

SEQ ID NO: 254 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
acaacgccgtgaaagatcagnnkcggttgatcgagccgctctc

SEQ ID NO: 255 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
gagagcggctcgatcaaccgmnnctgatctttcacggcgttgt

SEQ ID NO: 256 - DNA, 49 bp, Artificial Sequence
  mutagenesis primer
  misc_feature (23)..(23): n is g, a, t or c
  misc_feature (24)..(24): n is g, a, t or c
  misc_feature (25)..(25): k is g or t
caacgccgtgaaagatcagggcnnkttgatcgagccgctctcgtaaggr

SEQ ID NO: 257 - DNA, 48 bp, Artificial Sequence
  mutagenesis primer
  misc_feature (24)..(24): m is a or c
  misc_feature (25)..(25): n is g, a, t or c
  misc_feature (26)..(26): n is g, a, t or c
ccttacgagagcggctcgatcaamnngccctgatctttcacggcgttg

SEQ ID NO: 258 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
ccgtgaaagatcagggccggnnkatcgagccgctctcgtaagg

SEQ ID NO: 259 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
ccttacgagagcggctcgatmnnccggccctgatctttcacgg

SEQ ID NO: 260 - DNA, 44 bp, Artificial Sequence
  mutagenesis primer
  misc_feature (23)..(23): n is g, a, t or c
  misc_feature (24)..(24): n is g, a, t or c
  misc_feature (25)..(25): k is g or t
gaaagatcagggccggttgatcnnkccgctctcgtaaggatccg

SEQ ID NO: 261 - DNA, 44 bp, Artificial Sequence
  mutagenesis primer
  misc_feature (20)..(20): m is a or c
  misc_feature (21)..(21): n is g, a, t or c
  misc_feature (22)..(22): n is g, a, t or c
cggatccttacgagagcggmnngatcaaccggccctgatctttc

SEQ ID NO: 262 - DNA, 43 bp, Artificial Sequence
  mutagenesis primer
  misc_feature (21)..(21): n is g, a, t or c
  misc_feature (22)..(22): n is g, a, t or c
  misc_feature (23)..(23): k is g or t
atcagggccggttgatcgagnnkctctcgtaaggatccgaatt

SEQ ID NO: 263 - DNA, 43 bp, Artificial Sequence
  mutagenesis primer
  misc_feature (21)..(21): m is a or c
  misc_feature (22)..(22): n is g, a, t or c
  misc_feature (23)..(23): n is g, a, t or c
aattcggatccttacgagagmnnctcgatcaaccggccctgat

SEQ ID NO: 264 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
cagggccggttgatcgagccgnnktcgtaaggatccgaattcaag

SEQ ID NO: 265 - DNA, 45 bp, Artificial Sequence
  mutagenesis primer
  misc_feature (22)..(22): m is a or c
  misc_feature (23)..(23): n is g, a, t or c
  misc_feature (24)..(24): n is g, a, t or c
cttgaattcggatccttacgamnncggctcgatcaaccggccctg

SEQ ID NO: 266 - DNA, 42 bp, Artificial Sequence
  mutagenesis primer
  misc_feature (21)..(21): n is g, a, t or c
  misc_feature (22)..(22): n is g, a, t or c
  misc_feature (23)..(23): k is g or t
gccggttgatcgagccgctcnnktaaggatccgaattcaagc

SEQ ID NO: 267 - DNA, 42 bp, Artificial Sequence
  mutagenesis primer
  misc_feature (20)..(20): m is a or c
  misc_feature (21)..(21): n is g, a, t or c
  misc_feature (22)..(22): n is g, a, t or c
gcttgaattcggatccttamnngagcggctcgatcaaccggc

SEQ ID NO: 268 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
tccgtcggtaacggcaagcagnnkacctgggacaggtccgacagc

SEQ ID NO: 269 - DNA, 42 bp, Artificial Sequence
  mutagenesis primer
  misc_feature (20)..(20): n is g, a, t or c
  misc_feature (21)..(21): n is g, a, t or c
  misc_feature (22)..(22): k is g or t
cggtaacggcaagcaggaannktgggacaggtccgacagccg

SEQ ID NO: 270 - DNA, 42 bp, Artificial Sequence
  mutagenesis primer
  misc_feature (21)..(21): m is a or c
  misc_feature (22)..(22): n is g, a, t or c
  misc_feature (23)..(23): n is g, a, t or c
cggctgtcggacctgtcccamnnttcctgcttgccgttaccg

SEQ ID NO: 271 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
ggtaacggcaagcaggaaaccnnkgacaggtccgacagccgtggc

SEQ ID NO: 272 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
aacggcaagcaggaaacctggnnkaggtccgacagccgtggcttc

SEQ ID NO: 273 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
ggcaagcaggaaacctgggacnnktccgacagccgtggcttcgtg

SEQ ID NO: 274 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
aagcaggaaacctgggacaggnnkgacagccgtggcttcgtgctt

SEQ ID NO: 275 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
caggaaacctgggacaggtccnnkagccgtggcttcgtgctttcc

SEQ ID NO: 276 - DNA, 42 bp, Artificial Sequence
  mutagenesis primer
  misc_feature (22)..(22): n is g, a, t or c
  misc_feature (23)..(23): n is g, a, t or c
  misc_feature (24)..(24): k is g or t
gaaacctgggacaggtccgacnnkcgtggcttcgtgctttcc

SEQ ID NO: 277 - DNA, 42 bp, Artificial Sequence
  mutagenesis primer
  misc_feature (19)..(19): m is a or c
  misc_feature (20)..(20): n is g, a, t or c
  misc_feature (21)..(21): n is g, a, t or c
ggaaagcacgaagccacgmnngtcggacctgtcccaggtttc

SEQ ID NO: 278 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
acctgggacaggtccgacagcnnkggcttcgtgctttccctgaag

SEQ ID NO: 279 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
tgggacaggtccgacagccgtnnkttcgtgctttccctgaagaag

SEQ ID NO: 280 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
gacaggtccgacagccgtggcnnkgtgctttccctgaagaagaat

SEQ ID NO: 281 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
aggtccgacagccgtggcttcnnkctttccctgaagaagaatggc

SEQ ID NO: 282 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
tccgacagccgtggcttcgtgnnktccctgaagaagaatggcgcg

SEQ ID NO: 283 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
gacagccgtggcttcgtgcttnnkctgaagaagaatggcgcgcaa

SEQ ID NO: 284 - DNA, 45 bp, Artificial Sequence
  mutagenesis primer
  misc_feature (22)..(22): n is g, a, t or c
  misc_feature (23)..(23): n is g, a, t or c
  misc_feature (24)..(24): k is g or t
agccgtggcttcgtgctttccnnkaagaagaatggcgcgcaacac

SEQ ID NO: 285 - DNA, 16 bp, Artificial Sequence
  16S primer
taccttgttacgactt

SEQ ID NO: 286 - DNA, 20 bp, Artificial Sequence
  16S primer
agagtttgatcmtggctcag

SEQ ID NO: 287 - DNA, 261 bp, Artificial Sequence
  coding sequence for PIP-72 polypeptide
atggcgatttctgttaaaaacaatgcgtccaaccccgtcgaagtcgccatcaatcattggggtacagacggagacaccaaaccgttttccgtcgcgccgggcgcctccgatagctgggacaggaacgaccttcgtggcttcgtgatgtatgttcaactgggcggctccgcacacccttactacgttctgagcaccagcaacattgtgatctatgacgataaagtgaccgattcgggccaaactcttctgccgctctcgtaa

SEQ ID NO: 288 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacttgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 289 - DNA, 261 bp, Artificial Sequence
  coding sequence for PIP-72 polypeptide
atggccattactgttaaaaacagcgcgtccaacactattgaagtctcgatcaatcattggggtactgacggagacaccaagccgtttaaagtggctccaggcgccagtgaaacttgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 290 - DNA, 261 bp, Artificial Sequence
  coding sequence for PIP-72 polypeptide
atggccattactgttaaaaacagcgcgtccaacactattgaagtctcgatcaatcattggggtagtgacggagacaccaagccgtttaaagtggctccaggcgccagtgaaacttgggacaggaacgacttacgtggcttcgtgttgtacctgcagctgggtggctcggctaccccttactacgttttgtcaactagcaacattgtcatttacgatgataaagtgaccgatagtggccagacgattttgccgctctcgtaa

SEQ ID NO: 291 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 292 - DNA, 261 bp, Artificial Sequence
  coding sequence for PIP-72 polypeptide
atggccattagcgttaaaaacagcgcttccaacacggttgaagtcgctatcaatcattggggtactgacggagacaccaagccgtttaaagtggctccaggcgccagtgaaacttgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 293 - DNA, 261 bp, Artificial Sequence
  coding sequence for PIP-72 polypeptide
atggccattactgttaaaaacagcgcttccaacacggttgaagtcgctatcaatcattggggtactgacggagacaccaagccgtttaaagtggctccaggcgccagtgaaacttgggacaggaacgacttacgtggcttcgtgctgtacgtgcagctggggggctcggctaccccttactacgttttgtcaagtagcaacattgtcatttacgatgataaagtgaccgatagtggccagacgattttgccgctctcgtaa

SEQ ID NO: 294 - DNA, 261 bp, Artificial Sequence
  coding sequence for PIP-72 polypeptide
atggccattactgttaaaaacagcgcgtccaacactattgaagtcgctatcaatcattggggtactgacggagacaccaagccgtttaaagtggctccaggcgccagtgaaacttgggacaggaacgacttacgtggcttcgtgatgtacgtgaagctggggggctcggctaccccttactacgttttgtcaagtagcaacattgtcatttacgatgataaagtgaccgatagtggccagacgattttgccgctctcgtaa

SEQ ID NO: 295 - DNA, 261 bp, Artificial Sequence
  coding sequence for PIP-72 polypeptide
atggccattactgttaaaaacagcgcgtccaacactattgaagtctcgatcaatcattggggtactgacggagacaccaagccgtttaaagtggccccgggcgctagcgaaacctgggacaggaacgacttacgtggcttcgtgatgtacgtgcagctggggggctcggctaccccttactacgttttgtcaagtagcaacattgtcatttacgatgataaagtgaccgatagtggccagacgattttgccgctctcgtaa

SEQ ID NO: 296 - DNA, 261 bp, Artificial Sequence
  coding sequence for PIP-72 polypeptide
atggccattactgttaaaaacagcgcgtccaacactattgaagtctcgatcaatcattggggtactgacggagacaccaagccgtttaaagtggccccgggcgctagcgatagctgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 297 - DNA, 261 bp, Artificial Sequence
  coding sequence for PIP-72 polypeptide
atggccattagcgttaaaaacagctcttccaacacgattgaagtcgctatcaatcattggggtactgacggagacaccaagccgtttaaagtggctccaggcgccagtgaaacttgggacaggaacgacttacgtggcttcgtgttgtacgtgcagctgggtggctcggctaccccttactacgttttgtcaagtagcaacattgtcatttacgatgataaagtgaccgatagtggccagacgattttgccgctctcgtaa

SEQ ID NO: 298 - DNA, 261 bp, Artificial Sequence
  coding sequence for PIP-72 polypeptide
atggccattaccgttaaaaacaactcttccaacacgattgaagtctctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 299 - DNA, 261 bp, Artificial Sequence
  coding sequence for PIP-72 polypeptide
atggccattaccgttaaaaacaacgcttccaacacgattgaagtcgctatcaatcattggggtactgacggagacaccaaaccgtttaaaatggccccgggcgctagcgaaagctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 300 - DNA, 261 bp, Artificial Sequence
  coding sequence for PIP-72 polypeptide
atggccattagcgttaaaaacaacgcttccaacacggtcgaagtctctatcaatcattggggtactgacggagacaccaaaccgtttaaaatggccccgggcgctagcgatacttgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 301 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 302 - DNA, 261 bp, Artificial Sequence
  coding sequence for PIP-72 polypeptide
atggccattagcgttaaaaacagctcttccaacacgattgaagtctctatcaatcattggggtactgacggagacaccaaaccgtttaaaatggccccgggcgctagcgatacctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 303 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacttgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 304 - DNA, 261 bp, Artificial Sequence
  coding sequence for PIP-72 polypeptide
atggccattaccgttaaaaacagctcttccaacacgattgaagtcgctatcaatcattggggtactgacggagacaccaaaccgtttaaaatggccccgggcgctagcgaaacctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 305 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 306 - DNA, 261 bp, Artificial Sequence
  coding sequence for PIP-72 polypeptide
atggccattagcgttaaaaacagctcttccaacacgattgaagtctctatcaatcattggggtactgacggagacaccaaaccgtttaaaatggccccgggcgctagcgaaacctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 307 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgaaacctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 308 - DNA, 261 bp, Artificial Sequence
  coding sequence for PIP-72 polypeptide
atggccattaccgttaaaaacagcgcttccaacacggttgaagtctctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 309 - DNA, 261 bp, Artificial Sequence
  coding sequence for PIP-72 polypeptide
atggccattagcgttaaaaacagcgcatccaacacgattgaagtctctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 310 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgaaacctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 311 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatagctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 312 - DNA, 261 bp, Artificial Sequence
  coding sequence for PIP-72 polypeptide
atggccattaccgttaaaaacaacgcttccaacacggttgaagtcgctatcaatcattggggtactgacggagacaccaaaccgtttaaaatggccccgggcgctagcgaaacctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 313 - DNA, 261 bp, Artificial Sequence
  coding sequence for PIP-72 polypeptide
atggccattagcgttaaaaacaactcttccaacacgattgaagtctctatcaatcattggggtactgacggagacaccaaaccgtttaaaatggccccgggcgctagcgatagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 314 - DNA, 261 bp, Artificial Sequence
  coding sequence for PIP-72 polypeptide
atggccattagcgttaaaaacagcgcttccaacacgattgaagtctctatcaatcattggggtactgacggagacaccaaaccgtttaaaatggccccgggcgctagcgatagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 315 - DNA, 261 bp, Artificial Sequence
  coding sequence for PIP-72 polypeptide
atggccattagcgttaaaaacagctcttccaacacggttgaagtcgctatcaatcattggggtactgacggagacaccaaaccgtttaaaatggccccgggcgctagcgatagctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 316 - DNA, 261 bp, Artificial Sequence
  coding sequence for PIP-72 polypeptide
atggccattaccgttaaaaacagcgcttccaacacgattgaagtcgctatcaatcattggggtactgacggagacaccaaaccgtttaaaatggccccgggcgctagcgatacctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 317 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 318 - DNA, 261 bp, Artificial Sequence
  coding sequence for PIP-72 polypeptide
atggccattagtgttaaaaacaactcttccaacacggttgaagtcgctatcaatcattggggtactgacggagacaccaaaccgtttaaaatggccccgggcgctagcgaaagctgggacaggaacgaccttcgtggcttcgtgatgtacgtgcaactggggggctcagcgactccttactacgttcttagcactagcaatattgtcatttacgatgataaagtgacagatagcggccagacactgctgccgctctcgtaa

SEQ ID NO: 319 - DNA, 261 bp, Artificial Sequence
  coding sequence for PIP-72 polypeptide
atggccattagcgttaaaaacagctcttccaacacggttgaagtcgctatcaatcattggggtactgacggagacaccaaaccgtttaaaatggccccgggcgctagcgaaagctgggacaggaacgaccttcgtggcttcgtgatgtacgtgcagctggggggctcagcgactccttactacgttcttagcactagcaatattgtcatttacgatgataaagtgacagatagcggccagacactgctgccgctctcgtaa

SEQ ID NO: 320 - DNA, 261 bp, Artificial Sequence
  coding sequence for PIP-72 polypeptide
atggccattaccgttaaaaacagcgcttccaacacggttgaagtcgctatcaatcattggggtactgacggagacaccaaaccgtttaaaatggccccgggcgctagcgatacctgggacaggaacgaccttcgtggcttcgtgatgtacgtgaagctggggggctcagcgactccttactacgttcttagcactagcaatattgtcatttacgatgataaagtgacagatagcggccagacactgctgccgctctcgtaa

SEQ ID NO: 321 - DNA, 261 bp, Artificial Sequence
  coding sequence for PIP-72 polypeptide
atggccattagcgttaaaaacagcgcatccaacacggtcgaagtctcaatcaatcattggggtactgacggagacaccaaaccgtttaaaatggccccgggcgctagcgatacttgggacaggaacgaccttcgtggcttcgtgctgtacgtgaagctggggggctcagcgactccttactacgttcttagcactagcaatattgtcatttacgatgataaagtgacagatagcggccagacactgctgccgctctcgtaa

SEQ ID NO: 322 - DNA, 261 bp, Artificial Sequence
  coding sequence for PIP-72 polypeptide
atggccattagcgttaaaaacagctcttccaacacggttgaagtctctatcaatcattggggtactgacggagacaccaaaccgtttaaaatggccccgggcgctagcgatacctgggacaggaacgaccttcgtggcttcgtgctgtacgtgcagctggggggctcagcgactccttactacgttcttagcactagcaatattgtcatttacgatgataaagtgacagatagcggccagacactgctgccgctctcgtaa

SEQ ID NO: 323 - DNA, 261 bp, Artificial Sequence
  coding sequence for PIP-72 polypeptide
atggcaattagtgttacaaacagtgcgtccaaccccgttgaagtcgcgatcaatcattggggtacggacggagacaccagcttcttttccgtcgcaaacggcaagcaggaaagttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 324 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagttaattttgccgttaagttaa

SEQ ID NO: 325 - DNA, 261 bp, Artificial Sequence
  coding sequence for PIP-72 polypeptide
atggcaatttcagttacaaacaatgcgtccaaccccattgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 326 - DNA, 261 bp, Artificial Sequence
  coding sequence for PIP-72 polypeptide
atggcaattagtgttacaaacaatgcgtccaaccccgttgaagtcgcgatcaatcattggggtacggacggagacaccagcttcttttccgtcgcaaacggcaagcaggactcttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 327 - DNA, 261 bp, Artificial Sequence
  coding sequence for PIP-72 polypeptide
atggcaattagtgttacaaacaatgcgtccaaccccattgaagtcgcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 328 - DNA, 261 bp, Artificial Sequence
  coding sequence for PIP-72 polypeptide
atggcaattagtgttacaaacagtgcgtccaaccccgttgaagtcgcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 329 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaacttgggacaggtccgacctgcgtggcttcgtgttgtccgtgcagaagaatggcgcgcaacacccttactacgttctttccaccagcaatattgtcatttatgatgacaaggtgacggattccggccagacattgctgccgctctcgtaa

SEQ ID NO: 330 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaagttgggacaggtccgacctgcgtggcttcgtgttgtccgtgcagaagaatggcgcgcaacacccttactacgttctttccaccagcaatattgtcatttatgatgacaaggtgacggattccggccagacattgctgccgctctcgtaa

SEQ ID NO: 331 - DNA, 261 bp, Artificial Sequence
  coding sequence for PIP-72 polypeptide
atggcaatttcagttacaaacaatgcgtccaaccccgttgaagtctcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtag

SEQ ID NO: 332 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacgcttgaaccgttaagttaa

SEQ ID NO: 333 - DNA, 261 bp, Artificial Sequence
  coding sequence for PIP-72 polypeptide
atggcaatttcagttacaaacaatgcgtccaaccccgtggaagtcgcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 334 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 335 - DNA, 261 bp, Artificial Sequence
  coding sequence for PIP-72 polypeptide
atggcaatttcagttacaaacaattcgtccaaccccattgaagtcgcgatcaatcattggggtacggacggagacaccagcttcttttccgtcgcaaacggcaagcaggactcttgggacaggtccgacctgcgtggcttcgtgttgtccgtgaagaagaatggcgcgcaacacccttactacgttctttccaccagcaatattgtcatttatgatgacaaggtgacggattccggccagacattgctgccgctctcgtaa

SEQ ID NO: 336 - DNA, 261 bp, Artificial Sequence
  coding sequence for PIP-72 polypeptide
atggcaattagtgttacaaacaattcgtccaaccccattgaagtcgcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 337 - DNA, 261 bp, Artificial Sequence
  coding sequence for PIP-72 polypeptide
atggcaatttcagttacaaacaatgcgtccaaccccattgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 338 - DNA, 261 bp, Artificial Sequence
  coding sequence for PIP-72 polypeptide
atggcaatttcagttacaaacagtgcgtccaaccccgttgaagtctcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 339 - DNA, 261 bp, Artificial Sequence
  coding sequence for PIP-72 polypeptide
atggcaatttcagttacaaacaatgcgtccaaccccgttgaagtctcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacgattttgccgttaagttaa

SEQ ID NO: 340 - DNA, 261 bp, Artificial Sequence; identical to SEQ ID NO: 334
  coding sequence for PIP-72 polypeptide

SEQ ID NO: 341 - DNA, 261 bp, Artificial Sequence
  coding sequence for PIP-72 polypeptide
atggcaattactgttacaaacaattcgtccaaccccgttgaagtcgcgatcaatcattggggtacggacggagacaccagcttcttttccgtcgcaaacggcaagcaggaaacttgggacaggtccgacctgcgtggcttcgtgttgtccgtgaagaagaatggcgcgcaacacccttactacgttctttccaccagcaatattgtcatttatgatgacaaggtgacggattccggccagacgcttttgccggctagttaa

SEQ ID NO: 342 - DNA, 261 bp, Artificial Sequence
  coding sequence for PIP-72 polypeptide
atggcaattagtgttacaaacaatgcgtccaaccccgttgaagtctcgatcaatcattggggtacggacggagacaccagcttcttttccgtcgcaaacggcaagcaggaaacttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 343 - DNA, 261 bp, Artificial Sequence
  coding sequence for PIP-72 polypeptide
atggcaatttcagttacaaacaatgcgtccaaccccattgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagttaattttgccggctagttaa

SEQ ID NO: 344 - DNA, 261 bp, Artificial Sequence
  coding sequence for PIP-72 polypeptide
atggcaattagtgttacaaacaatgcgtccaaccccgttgaagtctcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagttaattgaaccgttaagttaa

SEQ ID NO: 345 - DNA, 261 bp, Artificial Sequence
  coding sequence for PIP-72 polypeptide
atggcaattagtgttacaaacaattcgtccaaccccattgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 346 - DNA, 261 bp, Artificial Sequence
  coding sequence for PIP-72 polypeptide
atggcaattagtgttacaaacaatgcgtccaaccccattgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 347 - DNA, 261 bp, Artificial Sequence
  coding sequence for PIP-72 polypeptide
atggcaattagtgttacaaacagtgcgtccaaccccgttgaagtcgcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 348 - DNA, 261 bp, Artificial Sequence
  coding sequence for PIP-72 polypeptide
atggcaattagtgttacaaacaatgcgtccaaccccattgaagtctcgatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacgcttgaaccgttaagttaa

SEQ ID NO: 349 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggactcttgggacaggtccgacctgcgtggcttcgtgatgtccgtgaagaagaatggcgcgcaacacccttactacgttctttccaccagcaatattgtcatttatgatgacaaggtgacggattccggccagacgattttgccgttaagttaa

SEQ ID NO: 350 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacatttgtaccggtttcttaa

SEQ ID NO: 351 - DNA, 261 bp, Artificial Sequence
  coding sequence for PIP-72 polypeptide
atggcaattactgttacaaacagtgcgtccaaccccgttgaagtcgcgatcaatcattggggtacggacggagacaccagcttcttttccgtcgcaaacggcaagcaggatagttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 352 - DNA, 261 bp, Artificial Sequence
  coding sequence for PIP-72 polypeptide
atggcaatttcagttacaaacaatgcgtccaaccccgtggaagtcgcgatcaatcattggggtacggacggagacaccagcttcttttccgtcgcaaacggcaagcaggatacttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 353 - DNA, 261 bp, Artificial Sequence
  coding sequence for PIP-72 polypeptide
atggcaattagtgttacaaacagttcgtccaaccccgttgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacattgctgccgctctcgtaa

SEQ ID NO: 354 - DNA, 261 bp, Artificial Sequence
  coding sequence for PIP-72 polypeptide
atggcaattagtgttacaaacaatgcgtccaaccccattgaagtcgcgatcaatcattggggtacggacggagacaccagcttcttttccgtcgcaaacggcaagcaggactcttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 355 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagttaattgaaccgttaagttaa

SEQ ID NO: 356 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggaaagttgggacaggtccgacctgcgtggcttcgtgttgtccgtgaagaagaatggcgcgcaacacccttactacgttctttccaccagcaatattgtcatttatgatgacaaggtgacggattccggccagttaattgaaccgttaagttaa

SEQ ID NO: 357 - DNA, 261 bp, Artificial Sequence
  coding sequence for PIP-72 polypeptide
atggcaattactgttacaaacaatgcgtccaaccccgttgaagtctcgatcaatcattggggtacggacggagacaccagcttcttttccgtcgcaaacggcaagcaggaaagttgggacaggtccgacctgcgtggcttcgtgatgtccgtgcagaagaatggcgcgcaacacccttactacgttctttccaccagcaatattgtcatttatgatgacaaggtgacggattccggccagacgcttttgccgttaaattaa

SEQ ID NO: 358 - DNA, 261 bp, Artificial Sequence
  coding sequence for PIP-72 polypeptide
atggcaattactgttacaaacagtgcgtccaaccccgttgaagtcgcgatcaatcattggggtacggacggagacaccagcttcttttccgtcgcaaacggcaagcaggatagttgggacaggtccgacctgcgtggcttcgtgatgtccgtgaagaagaatggcgcgcaacacccttactacgttctttccaccagcaatattgtcatttatgatgacaaggtgacggattccggccagacattgctgccgctctcgtaa

SEQ ID NO: 359 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggaaacttgggacaggtccgacctgcgtggcttcgtgttgtccgtgaagaagaatggcgcgcaacacccttactacgttctttccaccagcaatattgtcatttatgatgacaaggtgacggattccggccagacattgctgccgctctcgtaa

SEQ ID NO: 360 - DNA, 261 bp, Artificial Sequence
  coding sequence for PIP-72 polypeptide
atggcaattagtgttacaaacaattcgtccaaccccattgaagtcgcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacgattgaaccgttaagttaa

SEQ ID NO: 361 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggatacttgggacaggtccgacctgcgtggcttcgtgatgtccgtgaagaagaatggcgcgcaacacccttactacgttctttccaccagcaatattgtcatttatgatgacaaggtgacggattccggccagttacttttgccgttaagttaa

SEQ ID NO: 362 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggaaacttgggacaggtccgacctgcgtggcttcgtgatgtccgtgcagaagaatggcgcgcaacacccttactacgttctttccaccagcaatattgtcatttatgatgacaaggtgacggattccggccagacgattttgccgttaaattaa

SEQ ID NO: 363 - DNA, 261 bp, Artificial Sequence
  coding sequence for PIP-72 polypeptide
atggcaatttcagttacaaacaatgcgtccaaccccgtggaagtcgccatcaatcattggggtacggacggagacaccagcttcttttccgtcgcaaacggcaagcaggatagttgggacaggtccgacctgcgtggcttcgtgatgtccgtgaagaagaatggcgcgcaacacccttactacgttctttccaccagcaatattgtcatttatgatgacaaggtgacggattccggccagttacttgaaccgttaagttaa

SEQ ID NO: 364 - DNA, 261 bp, Artificial Sequence
  coding sequence for PIP-72 polypeptide
atggcaattagtgttacaaacaatgcgtccaaccccgttgaagtctcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagttacttgaaccgttaagttaa

SEQ ID NO: 365 - DNA, 261 bp, Artificial Sequence
  coding sequence for PIP-72 polypeptide
atggcaattagtgttacaaacagttcgtccaaccccgttgaagtctcgatcaatcattggggtacggacggagacaccagcttcttttccgtcgcaaacggcaagcaggactcttgggacaggtccgacctgcgtggcttcgtgatgtccgtgcagaagaatggcgcgcaacacccttactacgttctttccaccagcaatattgtcatttatgatgacaaggtgacggattccggccagacgcttttgccggctagttaa

SEQ ID NO: 366 - DNA, 261 bp, Artificial Sequence
  coding sequence for PIP-72 polypeptide
atggcaatttcagttacaaacaatgcgtccaaccccgttgaagtcgcgatcaatcattggggtacggacggagacaccagcttcttttccgtcgcaaacggcaagcaggatagttgggacaggtccgacctgcgtggcttcgtgttgtccgtgcagaagaatggcgcgcaacacccttactacgttctttccaccagcaatattgtcatttatgatgacaaggtgacggattccggccagacattgctgccgctctcgtaa

SEQ ID NO: 367 - DNA, 261 bp, Artificial Sequence
  coding sequence for PIP-72 polypeptide
atgggtattaccgttacaaacaactcgtccggcccgatcgaagtcgccatcaatcattggggtagcgacggagacacccaattctttcctgtcggcagcggcaagcaggaatcttgggacaggtccgacgatcgtggcttcgtgctttccctgaagaataatggcgcgcaacacccttactacgttcaggccagcagcaaaattgaagtcgagaacaactacgtgaaagattctggcgagttgatcctgccgctctcgtaa

SEQ ID NO: 368 - DNA, 261 bp, Artificial Sequence
  coding sequence for PIP-72 polypeptide
atgggtattaccgttacaaacaactcgtccggcgacatcgaagtcgccatcaatcattggggtagcgacggagacacccaattctttaaggtcgccccaggcaagcaggaatcttgggacaggtccgacgctcgtggcttcgtgctttccctgaagaataatggcgcgcaacacccttactacgttcaggccagcagcaaaattgaagtcgagaacaacgcggtgaaagatcagggccagttgatcctgccgctctcgtaa

SEQ ID NO: 369 - DNA, 261 bp, Artificial Sequence
  coding sequence for PIP-72 polypeptide
atgggtattaccgttacaaacaactcgtccggcgacatcgaagtcgccatcaatcattggggtagcgacggagacacctccttctttaaggtcgccccaggcaagcaggaaacttgggacaggtccgacgatcgtggcttcgtgctttccctgaagaataatggcgcgcaacacccttactacgttcaggccagcagcaaaattgaagtcgagaacgactacgtgaaagatcagggccagttgatcctgccgctctcgtaa

SEQ ID NO: 370 - DNA, 261 bp, Artificial Sequence
  coding sequence for PIP-72 polypeptide
atgggtattaccgttacaaacaacttgtccaacgacatcgaagtcgccatcaatcattggggtagcgacggagacacccaattctttaaggtcggcccaggcaagcaggaatcttgggacaggtccgacgctcgtggcttcgtgctttccctgaagaagaatggcgcgcaacacccttactacgttcaggccagcagcaaaattgaagtcgagaacgacgcggtgaaagattctggcgagttgatcctgccgctctcgtaa

SEQ ID NO: 371 - DNA, 261 bp, Artificial Sequence
  coding sequence for PIP-72 polypeptide
atgggtattaccgttacaaacagctcgtccggcgacatcgaagtcgccatcaatcattggggtagcgacggagacacctccttctttaaggtcggcagcggcaagcaggaatcttgggacaggtccgacgatcgtggcttcgtgctttccctgaagaataatggcgcgcaacacccttactacgttcaggccagcagcaaaattgaagtcgagaacaactacgtgaaagattctggcgagttgatcgagccgctctcgtaa

SEQ ID NO: 372 - DNA, 261 bp, Artificial Sequence
  coding sequence for PIP-72 polypeptide
atgggtattaccgttacaaacaactcgtccggcccgatcgaagtcgccatcaatcattggggtagcgacggagacacccaattctttaaggtcgccccaggcaagcaggaatcttgggacaggtccgacgatcgtggcttcgtgctttccctgaagaataatggcgcgcaacacccttactacgttcaggccagcagcaaaattgaagtcgagaacgacgcggtgaaagattctggcgagttgatcgagccgctctcgtaa

SEQ ID NO: 373 - DNA, 261 bp, Artificial Sequence
  coding sequence for PIP-72 polypeptide
atgggtattaccgttacaaacagctcgtccggcgacatcgaagtcgccatcaatcattggggtagcgacggagacacccaattctttaaggtcggcagcggcaagcaggaaacttgggacaggtccgacgatcgtggcttcgtgctttccctgaagaataatggcgcgcaacacccttactacgttcaggccagcagcaaaattgaagtcgagaacgacgcggtgaaagattctggccagttgatcgagccgctctcgtaa

SEQ ID NO: 374 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagcgcaatggcgcgcaagcaccttactacgttcaggccagcagcaaaattgaagtcgacaacaacgccgtgaaagatcagggccggttgatcgagccgctctcgtaa

SEQ ID NO: 375 - DNA, 261 bp, Artificial Sequence
  coding sequence for PIP-72 polypeptide
atgggtattaccgttacaaacaattcgtccaacccgatcgaagtggccatcaatcactggggtagcgacggagacaccagcttcttttccgtcggtaacggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 376 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccagttgatccagccgctctcgtaa

SEQ ID NO: 377 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 378 - DNA, 261 bp, Artificial Sequence
  coding sequence for PIP-72 polypeptide
atgggtattaccgttacaaacaattcgtccaacccgatcgaagcggccatcaataaatggggtagcgacggagacaccagcttcttttccgtcggtaacggcaagcaggaaacctgggacaggtccgacagccgtggcttcgtgctttccctgaagcgcaatggcgcgcaagcaccttactacgttcaggccagcagcaaaattgaagtcgacaacaacgccgtgaaagatcagggccggttgatcgagccgctctcgtaa

SEQ ID NO: 379 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagttgacaacaacaccgtgaaagatcagggccggttgatcgagccgctctcgtaa

SEQ ID NO: 380 - DNA, 261 bp, Artificial Sequence
  coding sequence for PIP-72 polypeptide
atgggtattaccgttacaaacaattcgtccaaccccatcgaagtggccatcaatcactggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccgtttgatccacccggtgtcttaa

SEQ ID NO: 381 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgcaatggcgcgcaagcaccttactacgttcaggccagcagcaaaattgaagtcgacaacaacgccgtgaaagatcagggccgtttgatccacccggtgtcttaa

SEQ ID NO: 382 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 383 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaaacctgggacaggtccgacagccgtggcttcgtgctttccctgaagcgcaatggcgcgcaacacccttactacgttcaggcctccagcaaaattgaagttgacaacaacaccgtgaaagatcagggcgaattgatcgagccgctgtcttaa

SEQ ID NO: 384 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcctgggacaggtccgacagccgtggcttcgtgctttccctgaagcgcaatggcgcgcaagcaccttactacgttcaggccagcagcaaaattgaagtcgacaacaacgccgtgaaagatcagggccgtttgatcgagccggtgtcttaa

SEQ ID NO: 385 - DNA, 261 bp, Artificial Sequence
  coding sequence for PIP-72 polypeptide
atgggtattaccgttacaaacaattcgtccaacccgatcgaagtggccatcaatcactggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccgtttgatccacccgctgtcttaa

SEQ ID NO: 386 - DNA, 261 bp, Artificial Sequence
  coding sequence for PIP-72 polypeptide
atgggtattaccgttacaaacaattcgtccaagaaaatcgaagtggccatcaataaatggggtagcgacggagacaccagcttcttttccgtcggtaacggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggccggttgatcgagccgctctcgtaa

SEQ ID NO: 387 - DNA, 261 bp, Artificial Sequence
  coding sequence for PIP-72 polypeptide
atgggtattaccgttacaaacaattcgtccaagccgatcgaagtggccatcaatcactggggtagcgacggagacactagcttctttggcgttgataacggcaagcaggaatcctgggacaggtccgacagccgtggcttcgtgctttccctgaagcgcaatggcgcgcaacacccttactacgttcaggccaccagcaaaattgaagttgaaaacaacaccgtgaaagatcagggccgtttgatcgagccggtggcttaa

SEQ ID NO: 388 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccaccagcaaaattgaaattgacaacaacgccgtgaaagatcagggccggttgatcgagccgctctcgtaa

SEQ ID NO: 389 - DNA, 261 bp, Artificial Sequence
  coding sequence for PIP-72 polypeptide
atgggtattaccgttacaaacaattcgtccaacccgatcgaagcggccatcaataaatggggtagcgacggagacaccagcttctttagcattgatagcggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 390 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 391 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaacaatggcgcgcaacacccttactacgttcaggccagcagcaaaattgaagtcgacaacaacgccgtgaaagatcagggccggttgatcgagccgctgtcttaa

SEQ ID NO: 392 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccgctgtcttaa

SEQ ID NO: 393 - DNA, 261 bp, Artificial Sequence
  coding sequence for PIP-72 polypeptide
atgggtattaccgttacaaacaattcgtccaacaaaatcgaagtggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 394 - DNA, 261 bp, Artificial Sequence
  coding sequence for PIP-72 polypeptide
atgggtattaccgttacaaacaattcgtccaacccgatcgaagtggccatcaatcactggggtagcgacggagacaccagcttctttggcgttggtagcggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 395 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggcgaattgatcgagccggtgtcttaa

SEQ ID NO: 396 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtggcttaa

SEQ ID NO: 397 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccgctgtcttaa

SEQ ID NO: 398 - DNA, 261 bp, Artificial Sequence
  coding sequence for PIP-72 polypeptide
atgggtattaccgttacaaacaattcgtccaagccgatcgaagtggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 399 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattggtagcggcaagcaggaatcctgggacaggtccgacagccgtggcttcgtgctttccctgaagaagaatggcgcgcaacacccttactacgttcaggccagcagcaaaattgaagttgacaacaacgccgtgaaagatcagggccgtttgatcgagccgctctcgtaa

SEQ ID NO: 400 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 401 - DNA, 261 bp, Artificial Sequence
  coding sequence for PIP-72 polypeptide
atgggtattaccgttacaaacaattcgtccaaccccatcgaagtcgccatcaataaatggggtagcgacggagacaccagcttcttttccgtcggtaacggcaagcaggaaacctgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 402 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 403 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 404 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 405 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagagtaatggcgcgcaacacccttactacgttcaggccagcagcaaaattgaagtcgacaacaacgccgtgaaagatcagggccggttgatcgagccgctctcgtaa

SEQ ID NO: 406 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaatcttgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 407 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 408 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 409 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 410 - DNA, 261 bp, Artificial Sequence
  coding sequence for PIP-72 polypeptide
atgggtattaccgttacaaacaattcgtccaaccccatcgaagctgccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 411 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 412 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaatcttgggacaggtccgacagccgtggcttcgtgctttccctgaagaagaatggcgcgcaagctccttactacgttcaggccagcagcaaaattgaagtcgacaacaacgccgtgaaagatcagggccggttgatcgagccgctctcgtaa

SEQ ID NO: 413 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaagtcgacaacaacacggtgaaagatcagggccggttgatcgagccgctctcgtaa

SEQ ID NO: 414 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaacacccttactacgttcaggccagcagcaaaattgaagtcgacaacaacgccgtgaaagatcagggccggttgatcgagccgctctcgtaa

SEQ ID NO: 415 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 416 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaagctccttactacgttcaggccagcagcaaaattgaagtcgacaacaacgccgtgaaagatcagggccggttgatcgagccgctctcgtaa

SEQ ID NO: 417 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 418 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaatcttgggacaggtccgacagccgtggcttcgtgctttccctgaagaagaatggcgcgcaagctccttactacgttcaggccagcagcaaaattgaagtcgacaacaacgcggtgaaagatcagggccggttgatcgagccgctctcgtaa

SEQ ID NO: 419 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaaacctgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 420 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccactagcaaaattgaaattgaaaacaacacggtgaaagatcagggccggttgatcgagccgctctcgtaa

SEQ ID NO: 421 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 422 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtagcggcaagcaggaatcttgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 423 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaaattgaaaacaacacggtgaaagatcagggccggttgatcgagccgctctcgtaa

SEQ ID NO: 424 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacacggtgaaagatcagggccggttgatcgagccgctctcgtaa

SEQ ID NO: 425 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttcttttccgtcggtaacggcaagcaggaaacctgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcgtaa

SEQ ID NO: 426 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagagtaatggcgcgcaagctccttactacgttcaggccagcagcaaaattgaagtcgacaacaacgccgtgaaagatcagggccggttgatcgagccgctctcgtaa

SEQ ID NO: 427 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggcgaattgatccacccggtcgcataa

SEQ ID NO: 428 - DNA, 261 bp, Artificial Sequence
  coding sequence for PIP-72 polypeptide
atgggtattaccgttacaaacaattcgtccaagaagatcgaagctgccatcaataaatggggtagcgacggagacaccagcttctttggcattgacagcggcaagcaggaatcttgggacaggtccgacagccgtggcttcgtgctttccctgaagcgtaatggcgcgcaagctccttactacgttcaggccactagcaaaattgaaattgaaaacaacacggtgaaagatcagggccggttgatcgagccgctctcgtaa

SEQ ID NO: 429 - DNA, 261 bp, Artificial Sequence
  coding sequence for PIP-72 polypeptide
atgggtattaccgttacaaacaattcgtccaaccccatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctggcttaa

SEQ ID NO: 430 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatcgagccggtgtcttaa

SEQ ID NO: 431 - DNA, 261 bp, Artificial Sequence
  coding sequence for PIP-72 polypeptide
atgggtattaccgttacaaacaattcgtccaaccccatcgaagtggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 432 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtgtcttaa

SEQ ID NO: 433 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 434 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtggcttaa

SEQ ID NO: 435 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggcgaattgatcgagccggtggcttaa

SEQ ID NO: 436 - DNA, 261 bp, Artificial Sequence
  coding sequence for PIP-72 polypeptide
atgggtattaccgttacaaacaattcgtccaagaaaatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 437 - DNA, 261 bp, Artificial Sequence
  coding sequence for PIP-72 polypeptide
atgggtattaccgttacaaacaattcgtccaagccgatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctggcttaa

SEQ ID NO: 438 - DNA, 261 bp, Artificial Sequence
  coding sequence for PIP-72 polypeptide
atgggtattaccgttacaaacaattcgtccaagccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 439 - DNA, 261 bp, Artificial Sequence
  coding sequence for PIP-72 polypeptide
atgggtattaccgttacaaacaattcgtccaagccgatcgaagcggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 440 - DNA, 261 bp, Artificial Sequence
  coding sequence for PIP-72 polypeptide
atgggtattaccgttacaaacaattcgtccaacaaaatcgaagtggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 441 - DNA, 261 bp, Artificial Sequence
  coding sequence for PIP-72 polypeptide
atgggtattaccgttacaaacaattcgtccaacaaaatcgaagcggccatcaataaatggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 442 - DNA, 261 bp, Artificial Sequence
  coding sequence for PIP-72 polypeptide
atgggtattaccgttacaaacaattcgtccaacaaaatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 443 - DNA, 261 bp, Artificial Sequence
  coding sequence for PIP-72 polypeptide
atgggtattaccgttacaaacaattcgtccaacccgatcgaagcggccatcaatcactggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 444 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctgtcttaa

SEQ ID NO: 445 - DNA, 261 bp, Artificial Sequence
  coding sequence for PIP-72 polypeptide
atgggtattaccgttacaaacaattcgtccaacccgatcgaagtggccatcaataaatggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 446 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatccacccggtgtcttaa

SEQ ID NO: 447 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 448 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgatagcggcaagcaggaatcctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 449 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcattgataacggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccggtgtcttaa

SEQ ID NO: 450 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggcgaattgatcgagccgctggcttaa

SEQ ID NO: 451 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggcgaattgatcgagccgctggcttaa

SEQ ID NO: 452 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttgataacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggcgaattgatccacccgctgtcttaa

SEQ ID NO: 453 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgatagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 454 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtaacggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 455 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggcgaattgatcgagccgctggcttaa

SEQ ID NO: 456 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtaacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 457 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattgatagcggcaagcaggaaacctgggacaggtccgacagccgtggcttcgtgctttccctgaagcgcaatggcgcgcaacacccttactacgttcaggccagcagcaaaattgaagtcgacaacaacgccgtgaaagatcagggccggttgatcgagccgctctcgtaa

SEQ ID NO: 458 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtgctttccctgaagcacaatggcgcgcaacccccttactacgttcaggccagcagcaaaattgaagtcgacaacaacgccgtgaaagatcagggccgtttgatccacccgctcgcttaa

SEQ ID NO: 459 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttgatagcggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccgtttgatcgagccggtggcttaa

SEQ ID NO: 460 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 461 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttggtagcggcaagcaggaatcctgggacaggtccgacagccgtggcttcgtgctttccctgaagcgcaatggcgcgcaagcaccttactacgttcaggccagcagcaaaattgaagtcgacaacaacgccgtgaaagatcagggcgaattgatcgagccgctgtcttaa

SEQ ID NO: 462 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattggtagcggcaagcaggaatcctgggacaggtccgacagccgtggcttcgtgctttccctgaagcgcaatggcgcgcaagcaccttactacgttcaggccagcagcaaaattgaagtcgacaacaacgccgtgaaagatcagggcgaattgatcgagccggtgtcttaa

SEQ ID NO: 463 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttagcgttgataacggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 464 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttgatagcggcaagcaggaaacctgggacaggtccgacagccgtggcttcgtgctttccctgaagaagaatggcgcgcaacacccttactacgttcaggccagcagcaaaattgaagtcgacaacaacgccgtgaaagatcagggccgtttgatcgagccggtggcttaa

SEQ ID NO: 465 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcattggtaacggcaagcaggaatcctgggacaggtccgacagccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 466 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttgatagcggcaagcaggaatcctgggacaggtccgacagccgtggcttcgtgctttccctgaagaagaatggcgcgcaagcaccttactacgttcaggccagcagcaaaattgaagtcgacaacaacgccgtgaaagatcagggccggttgatcgagccgctctcgtaa

SEQ ID NO: 467 - DNA, 261 bp, Artificial Sequence
  coding sequence for PIP-72 polypeptide
atgggtattaccgttacaaacaattcgtccaaccccatcgaagtcgccatcaatcattggggtagcgacggagacaccagcttctttggcgttggtagcggcaagcaggaaacctgggacaggtccgacagccgtggcttcgtgctttccctgaagaagaatggcgcgcaagcaccttactacgttcaggccagcagcaaaattgaagtcgacaacaacgccgtgaaagatcagggccggttgatcgagccgctctcgtaa

SEQ ID NO: 468 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 469 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcactcaagcaccttactacgttcaggccaccagcaaaattgaaattgaaaactctaccgtgaaagatcatggcgaaaccatccacccggtagcataa

SEQ ID NO: 470 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcatggcgaaaccatccacccggtagcataa

SEQ ID NO: 471 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcagggccgtttgatccacccggtgtcttaa

SEQ ID NO: 472 - DNA, 261 bp, Artificial Sequence
  coding sequence for PIP-72 polypeptide
atgggtattaccgttacaaacaattcgtccaagccgatcgaagcggccatcaatcactggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 473 - DNA, 261 bp, Artificial Sequence
  coding sequence for PIP-72 polypeptide
atgggtattaccgttacaaacaattcgtccaagccgatcgaagcggccatcaataaatggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 474 - DNA, 261 bp, Artificial Sequence
  coding sequence for PIP-72 polypeptide
atgggtattaccgttacaaacaattcgtccaagccgatcgaagcggccatcaataaatggggtagcgacggagacaccaaattctttggcatcgatagcggcaagcaggaatcctgggacaggtccgacgaccgtggcttcgtgctttccctgaagcgtaatggcgcgcaagcaccttactacgttcaggccaccagcaaaattgaaattgaaaactctaccgtgaaagatcagggcgaattgatccacccggtgtcttaa

SEQ ID NO: 475 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgtaatggcgcgcaacacccttactacgttcaggccaccagcaaaattgaaattgaaaactctaccgtgaaagatcatggcgaattgatcgagccggtggcttaa

SEQ ID NO: 476 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 477 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcagggcgaattgatcgagccgctggcttaa

SEQ ID NO: 478 - DNA, 261 bp, Artificial Sequence
  coding sequence for PIP-72 polypeptide
atgggtattaccgttacaaacaattcgtccaacaaaatcgaagcggccatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 479 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcagggcgaattgatccacccggtggcttaa

SEQ ID NO: 480 - DNA, 261 bp, Artificial Sequence
  coding sequence for PIP-72 polypeptide
atgggtattaccgttacaaacaaatcgtccaaaaaaatcgaagctagcatcaataaatggggtagagacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcagggccgtttgatccacccggtggcttaa

SEQ ID NO: 481 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttagcattggtagcggcaagcaggaaacctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 482 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttggtagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 483 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttgatagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 484 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 485 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacagccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 486 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttggtagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 487 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttagcattgatagcggcaagcaggaaacctgggacaggtccgacgaccgtggcttcgtgctttccctgaagcgcaatggcgcgcaacacccttactacgttcaggccaccaacaaaattgaaattgaaaactctaccgtgaaagatcatggcgaaaccatccacccggtagcataa

SEQ ID NO: 488 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 489 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacagccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 490 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagcgcaatggcgcgcaagcaccttactacgttcaggccaccagcaaaattgaaattgaaaactctaccgtgaaagatcagggcgaattgatccacccggtgtcttaa

SEQ ID NO: 491 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcgttggtagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcagggcgaattgatcgagccgctgtcttaa

SEQ ID NO: 492 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttgatagcggcaagcaggaaacctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 493 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcagggcgaattgatccacccggtggcttaa

SEQ ID NO: 494 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttagcgttggtagcggcaagcaggaaacctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 495 - DNA, 261 bp, Artificial Sequence
  coding sequence for PIP-72 polypeptide
atgggtattaccgttacaaacaattcgtccaacccgatcgaagtggccatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 496 - DNA, 261 bp, Artificial Sequence
  coding sequence for PIP-72 polypeptide
atgggtattaccgttacaaacaattcgtccaacaaaatcgaagcggccatcaataaatggggtagcgacggagacaccaaattctttggcatcgatagcggcaagcaggaatcctgggacaggtccgacgaccgtggcttcgtgctttccctgaagcgtaatggcgcgcaagcaccttactacgttcaggccaccagcaaaattgaaattgaaaactctaccgtgaaagatcatggcgaaaccatccacccggtagcataa

SEQ ID NO: 497 - DNA, 261 bp, Artificial Sequence
  coding sequence for PIP-72 polypeptide
atgggtattaccgttacaaacaattcgtccaacccgatcgaagtggccatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggcctccagcaaaattgaaattgaaaacaacgccgtgaaagatcagggcgaaaccatccacccggtagcataa

SEQ ID NO: 498 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcagggcgaattgatccacccgctggcttaa

SEQ ID NO: 499 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 500 - DNA, 261 bp, Artificial Sequence
  coding sequence for PIP-72 polypeptide
atgggtattaccgttacaaacaattcgtccaagaaaatcgaagcggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 501 - DNA, 261 bp, Artificial Sequence
  coding sequence for PIP-72 polypeptide
atgggtattaccgttacaaacaattcgtccaagccaatcgaagcggccatcaatcactggggtagcgacggagacaccaaattctttggcatcgatagcggcaagcaggaatcctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 502 - DNA, 261 bp, Artificial Sequence
  coding sequence for PIP-72 polypeptide
atgggtattaccgttacaaacaattcgtccaagccgatcgaagcggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 503 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcattgatagcggcaagcaggaatcctgggacaggtccgacgaccgtggcttcgtgctttccctgaagaagaatggcgcgcaagcaccttactacgttcaggccaccagcaaaattgaaattgaaaactctaccgtgaaagatcatggcgaaaccatccacccggtagcataa

SEQ ID NO: 504 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaagttgaaaacaacgccgtgaaagatcatggcgaaaccatccacccggtagcataa

SEQ ID NO: 505 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgacaacaacaccgtgaaagatcatggcgaaaccatccacccggtagcataa

SEQ ID NO: 506 - DNA, 261 bp, Artificial Sequence
  coding sequence for PIP-72 polypeptide
atgggtattaccgttacaaacaattcgtccaagaaaatcgaagcggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 507 - DNA, 261 bp, Artificial Sequence
  coding sequence for PIP-72 polypeptide
atgggtattaccgttacaaacaattcgtccaagccgatcgaagcggccatcaataaatggggtagcgacggagacaccaaattctttggcatcgatagcggcaagcaggaatcctgggacaggtccgacgaccgtggcttcgtgctttccctgaagcgtaatggcgcgcaagcaccttactacgttcaggccaccagcaaaattgaaattgaaaactctaccgtgaaagatcagggccgtttgatccacccgctgtcttaa

SEQ ID NO: 508 - DNA, 261 bp, Artificial Sequence
  coding sequence for PIP-72 polypeptide
atgggtattaccgttacaaacaattcgtccaagccgatcgaagcggccatcaataaatggggtagcgacggagacaccagcttctttagcgttgatagcggcaagcaggaaacctgggacaggtccgacgaccgtggcttcgtgctttccctgaagcgcaatggcgcgcaagcaccttactacgttcaggccaccagcaaaattgaaattgaaaactctaccgtgaaagatcatggcgaaaccatccacccggtagcataa

SEQ ID NO: 509 - DNA, 261 bp, Artificial Sequence
  coding sequence for PIP-72 polypeptide
atgggtattaccgttacaaacaaatcgtccaaaaaaatcgaagcggccatcaataaatggggtagcgacggagacaccagcttctttggcgttggtagcggcaagcaggaaacctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtggcttaa

SEQ ID NO: 510 - DNA, 261 bp, Artificial Sequence
  coding sequence for PIP-72 polypeptide
atgggtattaccgttacaaacaattcgtccaacccgatcgaagtggccatcaataaatggggtagcgacggagacaccaaattctttggcattggtagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 511 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagagcaatggcgcgcaagcaccttactacgttcaggccaccagcaaaattgaaattgaaaactctaccgtgaaagatcatggcgaaaccatccacccggtagcataa

SEQ ID NO: 512 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccagcttctttggcgttggtagcggcaagcaggaaacctgggacaggtccgacgaccgtggcttcgtgctttccctgaagaagaatggcgcgcaacacccttactacgttcaggccaccagcaaaattgaaattgaaaactctaccgtgaaagatcagggcgaaaccatccacccggtagcataa

SEQ ID NO: 513 - DNA, 261 bp, Artificial Sequence
  coding sequence for PIP-72 polypeptide
atgggtattaccgttacaaacaaatcgtccaaaaaaatcgaagcggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggcctccagcaaaattgaaattgaaaacaacaccgtgaaagatcatggcgaaaccatccacccggtagcataa

SEQ ID NO: 514 - DNA, 261 bp, Artificial Sequence
  coding sequence for PIP-72 polypeptide
atgggtattaccgttacaaacaaatcgtccaaaaaaatcgaagctagcatcaatcactggggtagcgacggagacaccagcttctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 515 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaacaacgccgtgaaagatcagggccgtttgatcgagccggtggcttaa

SEQ ID NO: 516 - DNA, 261 bp, Artificial Sequence
  coding sequence for PIP-72 polypeptide
atgggtattaccgttacaaacaattcgtccaagccgatcgaagtggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 517 - DNA, 261 bp, Artificial Sequence
  coding sequence for PIP-72 polypeptide
atgggtattaccgttacaaacaaatcgtccaaaaaaatcgaagcggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 518 - DNA, 261 bp, Artificial Sequence; identical to SEQ ID NO: 473
  coding sequence for PIP-72 polypeptide

SEQ ID NO: 519 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcagggcgaattgatccacccggtgtcttaa

SEQ ID NO: 520 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 521 - DNA, 261 bp, Artificial Sequence
  coding sequence for PIP-72 polypeptide
atgggtattaccgttacaaacaattcgtccaagaaaatcgaagtggccatcaatcactggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 522 - DNA, 261 bp, Artificial Sequence; identical to SEQ ID NO: 476
  coding sequence for PIP-72 polypeptide

SEQ ID NO: 523 - DNA, 261 bp, Artificial Sequence
  coding sequence for PIP-72 polypeptide
atgggtattaccgttacaaacaattcgtccaagaaaatcgaagtggccatcaataaatggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 524 - DNA, 261 bp, Artificial Sequence
  coding sequence for PIP-72 polypeptide
atgggtattaccgttacaaacaaatcgtccaaaaaaatcgaagctagcatcaatcactggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 525 - DNA, 261 bp, Artificial Sequence
  coding sequence for PIP-72 polypeptide
atgggtattaccgttacaaacaattcgtccaagaaaatcgaagtggccatcaataaatggggtagcgacggagacaccaaattctttggcatcgatagcggcaagcaggaatcctgggacaggtccgacgaccgtggcttcgtgctttccctgaagaagaatggcgcgcaacacccttactacgttcaggccaccagcaaaattgaaattgaaaactctaccgtgaaagatcatggcgaaaccatccacccggtagcataa

SEQ ID NO: 526 - DNA, 261 bp, Artificial Sequence
  coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaaacctgggacaggtccgacgaccgtggcttcgtgctttccctgaagaagaatggcgcgcaagcaccttactacgttcaggccaccagcaaaattgaaattgaaaactctaccgtgaaagatcatggcgaaaccatccacccggtagcataa

SEQ ID NO: 527 - DNA, 261 bp, Artificial Sequence
  coding sequence for PIP-72 polypeptide
atgggtattaccgttacaaacaaatcgtccaaaaaaatcgaagtggccatcaatcactggggtagcgacggagacaccaaattctttggcatcgatagcggcaagcaggaatcctgggacaggtccgacgaccgtggcttcgtgctttccctgaagcgcaatggcgcgcaacacccttactacgttcaggccaccagcaaaattgaaattgaaaactctaccgtgaaagatcatggcgaaaccatccacccggtagcataa

SEQ ID NO: 528 - protein, 86 aa, Artificial Sequence
  PIP-72 polypeptide
MAISVKNNASNPVEVAINHWGTDGDTKPFSVAPGASDSWDRNDLRGFVMYVQLGGSAHPYYVLSTSNIVIYDDKVTDSGQTLLPLS

SEQ ID NO: 529 - protein, 86 aa, Artificial Sequence
  PIP-72 polypeptide
MAISVKNSASNTVEVSINHWGTDGDTKPFKMAPGASDTWDRNDLRGFVMYVQLGGSATPYYVLSTSNIVIYDDKVTDSGQTLLPLS

SEQ ID NO: 530 - protein, 86 aa, Artificial Sequence
  PIP-72 polypeptide
MAITVKNSASNTIEVSINHWGTDGDTKPFKVAPGASETWDRNDLRGFVLYVQLGGSATPYYVLSSSNIVIYDDKVTDSGQTILPLS

SEQ ID NO: 531 - protein, 86 aa, Artificial Sequence
  PIP-72 polypeptide
MAITVKNSASNTIEVSINHWGSDGDTKPFKVAPGASETWDRNDLRGFVLYLQLGGSATPYYVLSTSNIVIYDDKVTDSGQTILPLS

SEQ ID NO: 532 - protein, 86 aa, Artificial Sequence
  PIP-72 polypeptide
MAISVTNNASNPVEVAINHWGTDGDTSFFSVANGKQDSWDRSDLRGFVMSVQKNGAQHPYYVLSTSNIVIYDDKVTDSGQTLLPLS

SEQ ID NO: 533 - protein, 86 aa, Artificial Sequence
  PIP-72 polypeptide
MAISVKNSASNTVEVAINHWGTDGDTKPFKVAPGASETWDRNDLRGFVLYVQLGGSATPYYVLSSSNIVIYDDKVTDSGQTILPLS

SEQ ID NO: 534 - protein, 86 aa, Artificial Sequence
  PIP-72 polypeptide
MAITVKNSASNTVEVAINHWGTDGDTKPFKVAPGASETWDRNDLRGFVLYVQLGGSATPYYVLSSSNIVIYDDKVTDSGQTILPLS

SEQ ID NO: 535 - protein, 86 aa, Artificial Sequence
  PIP-72 polypeptide
MAITVKNSASNTIEVAINHWGTDGDTKPFKVAPGASETWDRNDLRGFVMYVKLGGSATPYYVLSSSNIVIYDDKVTDSGQTILPLS

SEQ ID NO: 536 - protein, 86 aa, Artificial Sequence
  PIP-72 polypeptide
MAITVKNSASNTIEVSINHWGTDGDTKPFKVAPGASETWDRNDLRGFVMYVQLGGSATPYYVLSSSNIVIYDDKVTDSGQTILPLS

SEQ ID NO: 537 - protein, 86 aa, Artificial Sequence
  PIP-72 polypeptide
MAITVKNSASNTIEVSINHWGTDGDTKPFKVAPGASDSWDRNDLRGFVLYVQLGGSATPYYVLSSSNIVIYDDKVTDSGQTILPLS

SEQ ID NO: 538 - protein, 86 aa, Artificial Sequence
  PIP-72 polypeptide
MAISVKNSSSNTIEVAINHWGTDGDTKPFKVAPGASETWDRNDLRGFVLYVQLGGSATPYYVLSSSNIVIYDDKVTDSGQTILPLS

SEQ ID NO: 539 - protein, 86 aa, Artificial Sequence
  PIP-72 polypeptide
MAITVKNNSSNTIEVSINHWGTDGDTKPFKMAPGASESWDRNDLRGFVMYVQLGGSATPYYVLSTSNIVIYDDKVTDSGQTLLPLS

SEQ ID NO: 540 - protein, 86 aa, Artificial Sequence
  PIP-72 polypeptide
MAITVKNNASNTIEVAINHWGTDGDTKPFKMAPGASESWDRNDLRGFVLYVQLGGSATPYYVLSTSNIVIYDDKVTDSGQTLLPLS

SEQ ID NO: 541 - protein, 86 aa, Artificial Sequence
  PIP-72 polypeptide
MAISVKNNASNTVEVSINHWGTDGDTKPFKMAPGASDTWDRNDLRGFVMYVQLGGSATPYYVLSTSNIVIYDDKVTDSGQTLLPLS

SEQ ID NO: 542 - protein, 86 aa, Artificial Sequence
  PIP-72 polypeptide
MAISVKNSASNTVEVSINHWGTDGDTKPFKMAPGASESWDRNDLRGFVMYVQLGGSATPYYVLSTSNIVIYDDKVTDSGQTLLPLS

SEQ ID NO: 543 - protein, 86 aa, Artificial Sequence
  PIP-72 polypeptide
MAISVKNSSSNTIEVSINHWGTDGDTKPFKMAPGASDTWDRNDLRGFVMYVQLGGSATPYYVLSTSNIVIYDDKVTDSGQTLLPLS

SEQ ID NO: 544 - protein, 86 aa, Artificial Sequence
  PIP-72 polypeptide
MAISVKNSASNTVEVSINHWGTDGDTKPFKMAPGASDTWDRNDLRGFVLYVQLGGSATPYYVLSTSNIVIYDDKVTDSGQTLLPLS

SEQ ID NO: 545 - protein, 86 aa, Artificial Sequence
  PIP-72 polypeptide
MAITVKNSSSNTIEVAINHWGTDGDTKPFKMAPGASETWDRNDLRGFVMYVQLGGSATPYYVLSTSNIVIYDDKVTDSGQTLLPLS

SEQ ID NO: 546 - protein, 86 aa, Artificial Sequence
  PIP-72 polypeptide
MAISVKNSASNTVEVSINHWGTDGDTKPFKMAPGASDSWDRNDLRGFVMYVQLGGSATPYYVLSTSNIVIYDDKVTDSGQTLLPLS

SEQ ID NO: 547 - protein, 86 aa, Artificial Sequence
  PIP-72 polypeptide
MAISVKNSSSNTIEVSINHWGTDGDTKPFKMAPGASETWDRNDLRGFVMYVQLGGSATPYYVLSTSNIVIYDDKVTDSGQTLLPLS

SEQ ID NO: 548 - protein, 86 aa, Artificial Sequence
  PIP-72 polypeptide
MAISVKNSASNTVEVSINHWGTDGDTKPFKMAPGASETWDRNDLRGFVLYVQLGGSATPYYVLSTSNIVIYDDKVTDSGQTLLPLS

SEQ ID NO: 549 - protein, 86 aa, Artificial Sequence
  PIP-72 polypeptide
MAITVKNSASNTVEVSINHWGTDGDTKPFKMAPGASESWDRNDLRGFVMYVQLGGSATPYYVLSTSNIVIYDDKVTDSGQTLLPLS

SEQ ID NO: 550 - protein, 86 aa, Artificial Sequence
  PIP-72 polypeptide
MAISVKNSASNTIEVSINHWGTDGDTKPFKMAPGASESWDRNDLRGFVMYVQLGGSATPYYVLSTSNIVIYDDKVTDSGQTLLPLS

SEQ ID NO: 551 - protein, 86 aa, Artificial Sequence
  PIP-72 polypeptide
MAISVKNSASNTVEVSINHWGTDGDTKPFKMAPGASETWDRNDLRGFVMYVQLGGSATPYYVLSTSNIVIYDDKVTDSGQTLLPLS

SEQ ID NO: 552 - protein, 86 aa, Artificial Sequence
  PIP-72 polypeptide
MAISVKNSASNTVEVSINHWGTDGDTKPFKMAPGASDSWDRNDLRGFVLYVQLGGSATPYYVLSTSNIVIYDDKVTDSGQTLLPLS

SEQ ID NO: 553 - protein, 86 aa, Artificial Sequence
  PIP-72 polypeptide
MAITVKNNASNTVEVAINHWGTDGDTKPFKMAPGASETWDRNDLRGFVMYVQLGGSATPYYVLSTSNIVIYDDKVTDSGQTLLPLS

SEQ ID NO: 554 - protein, 86 aa, Artificial Sequence
  PIP-72 polypeptide
MAISVKNNSSNTIEVSINHWGTDGDTKPFKMAPGASDSWDRNDLRGFVMYVQLGGSATPYYVLSTSNIVIYDDKVTDSGQTLLPLS

SEQ ID NO: 555 - protein, 86 aa, Artificial Sequence
  PIP-72 polypeptide
MAISVKNSASNTIEVSINHWGTDGDTKPFKMAPGASDSWDRNDLRGFVMYVQLGGSATPYYVLSTSNIVIYDDKVTDSGQTLLPLS

SEQ ID NO: 556 - protein, 86 aa, Artificial Sequence
  PIP-72 polypeptide
MAISVKNSSSNTVEVAINHWGTDGDTKPFKMAPGASDSWDRNDLRGFVLYVQLGGSATPYYVLSTSNIVIYDDKVTDSGQTLLPLS

SEQ ID NO: 557 - protein, 86 aa, Artificial Sequence
  PIP-72 polypeptide
MAITVKNSASNTIEVAINHWGTDGDTKPFKMAPGASDTWDRNDLRGFVMYVQLGGSATPYYVLSTSNIVIYDDKVTDSGQTLLPLS

SEQ ID NO: 558 - protein, 86 aa, Artificial Sequence; identical to SEQ ID NO: 544
  PIP-72 polypeptide

SEQ ID NO: 559 - protein, 86 aa, Artificial Sequence
  PIP-72 polypeptide
MAISVKNNSSNTVEVAINHWGTDGDTKPFKMAPGASESWDRNDLRGFVMYVQLGGSATPYYVLSTSNIVIYDDKVTDSGQTLLPLS

SEQ ID NO: 560 - protein, 86 aa, Artificial Sequence
  PIP-72 polypeptide
MAISVKNSSSNTVEVAINHWGTDGDTKPFKMAPGASESWDRNDLRGFVMYVQLGGSATPYYVLSTSNIVIYDDKVTDSGQTLLPLS

SEQ ID NO: 561 - protein, 86 aa, Artificial Sequence
  PIP-72 polypeptide
MAITVKNSASNTVEVAINHWGTDGDTKPFKMAPGASDTWDRNDLRGFVMYVKLGGSATPYYVLSTSNIVIYDDKVTDSGQTLLPLS

SEQ ID NO: 562 - protein, 86 aa, Artificial Sequence
  PIP-72 polypeptide
MAISVKNSASNTVEVSINHWGTDGDTKPFKMAPGASDTWDRNDLRGFVLYVKLGGSATPYYVLSTSNIVIYDDKVTDSGQTLLPLS

SEQ ID NO: 563 - protein, 86 aa, Artificial Sequence
  PIP-72 polypeptide
MAISVKNSSSNTVEVSINHWGTDGDTKPFKMAPGASDTWDRNDLRGFVLYVQLGGSATPYYVLSTSNIVIYDDKVTDSGQTLLPLS

SEQ ID NO: 564 - protein, 86 aa, Artificial Sequence
  PIP-72 polypeptide
MAISVTNSASNPVEVAINHWGTDGDTSFFSVANGKQESWDRSDLRGFVMSVKKNGAQHPYYVLSTSNIVIYDDKVTDSGQTLLPLS

SEQ ID NO: 565 - protein, 86 aa, Artificial Sequence
  PIP-72 polypeptide
MAISVTNNASNPVEVAINHWGTDGDTSFFSVANGKQDSWDRSDLRGFVMSVQKNGAQHPYYVLSTSNIVIYDDKVTDSGQLILPLS

SEQ ID NO: 566 - protein, 86 aa, Artificial Sequence
  PIP-72 polypeptide
MAISVTNNASNPIEVAINHWGTDGDTSFFSVANGKQESWDRSDLRGFVMSVQKNGAQHPYYVLSTSNIVIYDDKVTDSGQTLLPLS

SEQ ID NO: 567 - protein, 86 aa, Artificial Sequence
  PIP-72 polypeptide
MAISVTNNASNPVEVAINHWGTDGDTSFFSVANGKQDSWDRSDLRGFVMSVKKNGAQHPYYVLSTSNIVIYDDKVTDSGQTLLPLS

SEQ ID NO: 568 - protein, 86 aa, Artificial Sequence
  PIP-72 polypeptide
MAISVTNNASNPIEVAINHWGTDGDTSFFSVANGKQETWDRSDLRGFVMSVQKNGAQHPYYVLSTSNIVIYDDKVTDSGQTLLPLS

SEQ ID NO: 569 - protein, 86 aa, Artificial Sequence
  PIP-72 polypeptide
MAISVTNSASNPVEVAINHWGTDGDTSFFSVANGKQDSWDRSDLRGFVMSVQKNGAQHPYYVLSTSNIVIYDDKVTDSGQTLLPLS

SEQ ID NO: 570 - protein, 86 aa, Artificial Sequence
  PIP-72 polypeptide
MAISVTNNASNPVEVAINHWGTDGDTSFFSVANGKQETWDRSDLRGFVLSVQKNGAQHPYYVLSTSNIVIYDDKVTDSGQTLLPLS

SEQ ID NO: 571 - protein, 86 aa, Artificial Sequence
  PIP-72 polypeptide
MAISVTNNASNPVEVAINHWGTDGDTSFFSVANGKQESWDRSDLRGFVLSVQKNGAQHPYYVLSTSNIVIYDDKVTDSGQTLLPLS

SEQ ID NO: 572 - protein, 86 aa, Artificial Sequence
  PIP-72 polypeptide
MAISVTNNASNPVEVSINHWGTDGDTSFFSVANGKQDSWDRSDLRGFVMSVQKNGAQHPYYVLSTSNIVIYDDKVTDSGQTLLPLS

SEQ ID NO: 573 - protein, 86 aa, Artificial Sequence
  PIP-72 polypeptide
MAISVTNNASNPVEVAINHWGTDGDTSFFSVANGKQDSWDRSDLRGFVMSVQKNGAQHPYYVLSTSNIVIYDDKVTDSGQTLEPLS

SEQ ID NO: 574 - protein, 86 aa, Artificial Sequence
  PIP-72 polypeptide
MAISVTNNASNPVEVAINHWGTDGDTSFFSVANGKQETWDRSDLRGFVMSVQKNGAQHPYYVLSTSNIVIYDDKVTDSGQTLLPLS

SEQ ID NO: 575 - protein, 86 aa, Artificial Sequence
  PIP-72 polypeptide
MAISVTNNASNPVEVAINHWGTDGDTSFFSVANGKQESWDRSDLRGFVMSVQKNGAQHPYYVLSTSNIVIYDDKVTDSGQTLLPLS

SEQ ID NO: 576 - protein, 86 aa, Artificial Sequence
  PIP-72 polypeptide
MAISVTNNSSNPIEVAINHWGTDGDTSFFSVANGKQDSWDRSDLRGFVLSVKKNGAQHPYYVLSTSNIVIYDDKVTDSGQTLLPLS

SEQ ID NO: 577 - protein, 86 aa, Artificial Sequence
  PIP-72 polypeptide
MAISVTNNSSNPIEVAINHWGTDGDTSFFSVANGKQDTWDRSDLRGFVMSVQKNGAQHPYYVLSTSNIVIYDDKVTDSGQTLLPLS

SEQ ID NO: 578 - protein, 86 aa, Artificial Sequence
  PIP-72 polypeptide
MAISVTNNASNPIEVAINHWGTDGDTSFFSVANGKQDSWDRSDLRGFVMSVQKNGAQHPYYVLSTSNIVIYDDKVTDSGQTLLPLS

SEQ ID NO: 579 - protein, 86 aa, Artificial Sequence
  PIP-72 polypeptide
MAISVTNSASNPVEVSINHWGTDGDTSFFSVANGKQDTWDRSDLRGFVMSVQKNGAQHPYYVLSTSNIVIYDDKVTDSGQTLLPLS

SEQ ID NO: 580 - protein, 86 aa, Artificial Sequence
  PIP-72 polypeptide
MAISVTNNASNPVEVSINHWGTDGDTSFFSVANGKQETWDRSDLRGFVMSVQKNGAQHPYYVLSTSNIVIYDDKVTDSGQTILPLS

SEQ ID NO: 581 - protein, 86 aa, Artificial Sequence; identical to SEQ ID NO: 575
  PIP-72 polypeptide

SEQ ID NO: 582 - protein, 86 aa, Artificial Sequence
  PIP-72 polypeptide
MAITVTNNSSNPVEVAINHWGTDGDTSFFSVANGKQETWDRSDLRGFVLSVKKNGAQHPYYVLSTSNIVIYDDKVTDSGQTLLPAS

SEQ ID NO: 583 - protein, 86 aa, Artificial Sequence
  PIP-72 polypeptide
MAISVTNNASNPVEVSINHWGTDGDTSFFSVANGKQETWDRSDLRGFVMSVKKNGAQHPYYVLSTSNIVIYDDKVTDSGQTLLPLS

SEQ ID NO: 584 - protein, 86 aa, Artificial Sequence
  PIP-72 polypeptide
MAISVTNNASNPIEVAINHWGTDGDTSFFSVANGKQESWDRSDLRGFVMSVQKNGAQHPYYVLSTSNIVIYDDKVTDSGQLILPAS

SEQ ID NO: 585 - protein, 86 aa, Artificial Sequence
  PIP-72 polypeptide
MAISVTNNASNPVEVSINHWGTDGDTSFFSVANGKQDSWDRSDLRGFVMSVQKNGAQHPYYVLSTSNIVIYDDKVTDSGQLIEPLS

SEQ ID NO: 586 - protein, 86 aa, Artificial Sequence
  PIP-72 polypeptide
MAISVTNNSSNPIEVAINHWGTDGDTSFFSVANGKQDSWDRSDLRGFVMSVQKNGAQHPYYVLSTSNIVIYDDKVTDSGQTLLPLS

SEQ ID NO: 587 - protein, 86 aa, Artificial Sequence; identical to SEQ ID NO: 566
  PIP-72 polypeptide

SEQ ID NO: 588 - protein, 86 aa, Artificial Sequence
  PIP-72 polypeptide
MAISVTNSASNPVEVAINHWGTDGDTSFFSVANGKQETWDRSDLRGFVMSVQKNGAQHPYYVLSTSNIVIYDDKVTDSGQTLLPLS

SEQ ID NO: 589 - protein, 86 aa, Artificial Sequence
  PIP-72 polypeptide
MAISVTNNASNPIEVSINHWGTDGDTSFFSVANGKQETWDRSDLRGFVMSVQKNGAQHPYYVLSTSNIVIYDDKVTDSGQTLEPLS

SEQ ID NO: 590 - protein, 86 aa, Artificial Sequence
  PIP-72 polypeptide
MAISVTNNASNPVEVAINHWGTDGDTSFFSVANGKQDSWDRSDLRGFVMSVKKNGAQHPYYVLSTSNIVIYDDKVTDSGQTILPLS

SEQ ID NO: 591 - protein, 86 aa, Artificial Sequence
  PIP-72 polypeptide
MAISVTNNASNPVEVAINHWGTDGDTSFFSVANGKQDTWDRSDLRGFVMSVQKNGAQHPYYVLSTSNIVIYDDKVTDSGQTFVPVS

SEQ ID NO: 592 - protein, 86 aa, Artificial Sequence
  PIP-72 polypeptide
MAITVTNSASNPVEVAINHWGTDGDTSFFSVANGKQDSWDRSDLRGFVMSVQKNGAQHPYYVLSTSNIVIYDDKVTDSGQTLLPLS

SEQ ID NO: 593 - protein, 86 aa, Artificial Sequence
  PIP-72 polypeptide
MAISVTNNASNPVEVAINHWGTDGDTSFFSVANGKQDTWDRSDLRGFVMSVQKNGAQHPYYVLSTSNIVIYDDKVTDSGQTLLPLS

SEQ ID NO: 594 - protein, 86 aa, Artificial Sequence
  PIP-72 polypeptide
MAISVTNSSSNPVEVAINHWGTDGDTSFFSVANGKQDSWDRSDLRGFVMSVQKNGAQHPYYVLSTSNIVIYDDKVTDSGQTLLPLS

SEQ ID NO: 595 - protein, 86 aa, Artificial Sequence
  PIP-72 polypeptide
MAISVTNNASNPIEVAINHWGTDGDTSFFSVANGKQDSWDRSDLRGFVMSVKKNGAQHPYYVLSTSNIVIYDDKVTDSGQTLLPLS

SEQ ID NO: 596 - protein, 86 aa, Artificial Sequence
  PIP-72 polypeptide
MAISVTNNASNPVEVAINHWGTDGDTSFFSVANGKQESWDRSDLRGFVMSVQKNGAQHPYYVLSTSNIVIYDDKVTDSGQLIEPLS

SEQ ID NO: 597 - protein, 86 aa, Artificial Sequence
  PIP-72 polypeptide
MAISVTNNASNPVEVAINHWGTDGDTSFFSVANGKQESWDRSDLRGFVLSVKKNGAQHPYYVLSTSNIVIYDDKVTDSGQLIEPLS

SEQ ID NO: 598 - protein, 86 aa, Artificial Sequence
  PIP-72 polypeptide
MAITVTNNASNPVEVSINHWGTDGDTSFFSVANGKQESWDRSDLRGFVMSVQKNGAQHPYYVLSTSNIVIYDDKVTDSGQTLLPLN

SEQ ID NO: 599 - protein, 86 aa, Artificial Sequence
  PIP-72 polypeptide
MAITVTNSASNPVEVAINHWGTDGDTSFFSVANGKQDSWDRSDLRGFVMSVKKNGAQHPYYVLSTSNIVIYDDKVTDSGQTLLPLS

SEQ ID NO: 600 - protein, 86 aa, Artificial Sequence
  PIP-72 polypeptide
MAISVTNNASNPVEVAINHWGTDGDTSFFSVANGKQETWDRSDLRGFVLSVKKNGAQHPYYVLSTSNIVIYDDKVTDSGQTLLPLS

SEQ ID NO: 601 - protein, 86 aa, Artificial Sequence
  PIP-72 polypeptide
MAISVTNNSSNPIEVAINHWGTDGDTSFFSVANGKQDSWDRSDLRGFVMSVQKNGAQHPYYVLSTSNIVIYDDKVTDSGQTIEPLS

SEQ ID NO: 602 - protein, 86 aa, Artificial Sequence
  PIP-72 polypeptide
MAISVTNNASNPVEVAINHWGTDGDTSFFSVANGKQDTWDRSDLRGFVMSVKKNGAQHPYYVLSTSNIVIYDDKVTDSGQLLLPLS

SEQ ID NO: 603 - protein, 86 aa, Artificial Sequence
  PIP-72 polypeptide
MAISVTNNASNPVEVAINHWGTDGDTSFFSVANGKQETWDRSDLRGFVMSVQKNGAQHPYYVLSTSNIVIYDDKVTDSGQTILPLN

SEQ ID NO: 604 - protein, 86 aa, Artificial Sequence
  PIP-72 polypeptide
MAISVTNNASNPVEVAINHWGTDGDTSFFSVANGKQDSWDRSDLRGFVMSVKKNGAQHPYYVLSTSNIVIYDDKVTDSGQLLEPLS

SEQ ID NO: 605 - protein, 86 aa, Artificial Sequence
  PIP-72 polypeptide
MAISVTNNASNPVEVSINHWGTDGDTSFFSVANGKQDSWDRSDLRGFVMSVQKNGAQHPYYVLSTSNIVIYDDKVTDSGQLLEPLS

SEQ ID NO: 606 - protein, 86 aa, Artificial Sequence
  PIP-72 polypeptide
MAISVTNSSSNPVEVSINHWGTDGDTSFFSVANGKQDSWDRSDLRGFVMSVQKNGAQHPYYVLSTSNIVIYDDKVTDSGQTLLPAS

SEQ ID NO: 607 - protein, 86 aa, Artificial Sequence
  PIP-72 polypeptide
MAISVTNNASNPVEVAINHWGTDGDTSFFSVANGKQDSWDRSDLRGFVLSVQKNGAQHPYYVLSTSNIVIYDDKVTDSGQTLLPLS

SEQ ID NO: 608 - protein, 86 aa, Artificial Sequence
  PIP-72 polypeptide
MGITVTNNSSGPIEVAINHWGSDGDTQFFPVGSGKQESWDRSDDRGFVLSLKNNGAQHPYYVQASSKIEVENNYVKDSGELILPLS

SEQ ID NO: 609 - protein, 86 aa, Artificial Sequence
  PIP-72 polypeptide
MGITVTNNSSGDIEVAINHWGSDGDTQFFKVAPGKQESWDRSDARGFVLSLKNNGAQHPYYVQASSKIEVENNAVKDQGQLILPLS

SEQ ID NO: 610 - protein, 86 aa, Artificial Sequence
  PIP-72 polypeptide
MGITVTNNSSGDIEVAINHWGSDGDTSFFKVAPGKQETWDRSDDRGFVLSLKNNGAQHPYYVQASSKIEVENDYVKDQGQLILPLS

SEQ ID NO: 611 - protein, 86 aa, Artificial Sequence
  PIP-72 polypeptide
MGITVTNNLSNDIEVAINHWGSDGDTQFFKVGPGKQESWDRSDARGFVLSLKKNGAQHPYYVQASSKIEVENDAVKDSGELILPLS

SEQ ID NO: 612 - protein, 86 aa, Artificial Sequence
  PIP-72 polypeptide
MGITVTNSSSGDIEVAINHWGSDGDTSFFKVGSGKQESWDRSDDRGFVLSLKNNGAQHPYYVQASSKIEVENNYVKDSGELIEPLS

SEQ ID NO: 613 - protein, 86 aa, Artificial Sequence
  PIP-72 polypeptide
MGITVTNNSSGPIEVAINHWGSDGDTQFFKVAPGKQESWDRSDDRGFVLSLKNNGAQHPYYVQASSKIEVENDAVKDSGELIEPLS

SEQ ID NO: 614 - protein, 86 aa, Artificial Sequence
  PIP-72 polypeptide
MGITVTNSSSGDIEVAINHWGSDGDTQFFKVGSGKQETWDRSDDRGFVLSLKNNGAQHPYYVQASSKIEVENDAVKDSGQLIEPLS

SEQ ID NO: 615 - protein, 86 aa, Artificial Sequence
  PIP-72 polypeptide
MGITVTNNSSKPIEAAINHWGSDGDTSFFSVGNGKQETWDRSDSRGFVLSLKRNGAQAPYYVQASSKIEVDNNAVKDQGRLIEPLS

SEQ ID NO: 616 - protein, 86 aa, Artificial Sequence
  PIP-72 polypeptide
MGITVTNNSSNPIEVAINHWGSDGDTSFFSVGNGKQESWDRSDSRGFVLSLKRNGAQHPYYVQASSKIEVDNNAVKDQGRLIEPLS

SEQ ID NO: 617 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGQLIQPLS

SEQ ID NO: 618 - protein, 86 aa, Artificial Sequence
  PIP-72 polypeptide
MGITVTNNSSKPIEVAINHWGSDGDTSFFSVGNGKQESWDRSDSRGFVLSLKKNGAQHPYYVQASSKIEVDNNAVKDQGRLIEPLS

SEQ ID NO: 619 - protein, 86 aa, Artificial Sequence
  PIP-72 polypeptide
MGITVTNNSSNPIEAAINKWGSDGDTSFFSVGNGKQETWDRSDSRGFVLSLKRNGAQAPYYVQASSKIEVDNNAVKDQGRLIEPLS

SEQ ID NO: 620 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNTVKDQGRLIEPLS

SEQ ID NO: 621 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGRLIHPVS

SEQ ID NO: 622 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEVDNNAVKDQGRLIHPVS

SEQ ID NO: 623 - protein, 86 aa, Artificial Sequence
  PIP-72 polypeptide
MGITVTNNSSKPIEAAINHWGSDGDTSFFSVGNGKQETWDRSDSRGFVLSLKRNGAQHPYYVQASSKIEVDNNAVKDQGRLIEPLS

SEQ ID NO: 624 - protein, 86 aa, Artificial Sequence
  PIP-72 polypeptide
MGITVTNNSSNPIEVAINHWGSDGDTSFFSVGSGKQETWDRSDSRGFVLSLKRNGAQHPYYVQASSKIEVDNNTVKDQGELIEPLS

SEQ ID NO: 625 - protein, 86 aa, Artificial Sequence
  PIP-72 polypeptide
MGITVTNNSSNPIEVAINHWGSDGDTSFFSVGNGKQESWDRSDSRGFVLSLKRNGAQAPYYVQASSKIEVDNNAVKDQGRLIEPVS

SEQ ID NO: 626 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGRLIHPLS

SEQ ID NO: 627 - protein, 86 aa, Artificial Sequence
  PIP-72 polypeptide
MGITVTNNSSKKIEVAINKWGSDGDTSFFSVGNGKQETWDRSDSRGFVLSLKKNGAQAPYYVQASSKIEVDNNAVKDQGRLIEPLS

SEQ ID NO: 628 - protein, 86 aa, Artificial Sequence
  PIP-72 polypeptide
MGITVTNNSSKPIEVAINHWGSDGDTSFFGVDNGKQESWDRSDSRGFVLSLKRNGAQHPYYVQATSKIEVENNTVKDQGRLIEPVA

SEQ ID NO: 629 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQATSKIEIDNNAVKDQGRLIEPLS

SEQ ID NO: 630 - protein, 86 aa, Artificial Sequence
  PIP-72 polypeptide
MGITVTNNSSNPIEAAINKWGSDGDTSFFSIDSGKQESWDRSDSRGFVLSLKRNGAQHPYYVQASSKIEVDNNAVKDQGRLIEPLS

SEQ ID NO: 631 - protein, 86 aa, Artificial Sequence; identical to SEQ ID NO: 616
  PIP-72 polypeptide

SEQ ID NO: 632 - protein, 86 aa, Artificial Sequence
  PIP-72 polypeptide
MGITVTNNSSNPIEVAINHWGSDGDTSFFSVGNGKQETWDRSDSRGFVLSLKNNGAQHPYYVQASSKIEVDNNAVKDQGRLIEPLS

SEQ ID NO: 633 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGRLIHPLS

SEQ ID NO: 634 - protein, 86 aa, Artificial Sequence
  PIP-72 polypeptide
MGITVTNNSSNKIEVAINKWGSDGDTSFFSVGNGKQETWDRSDSRGFVLSLKKNGAQHPYYVQASSKIEVDNNAVKDQGRLIEPLS

SEQ ID NO: 635 - protein, 86 aa, Artificial Sequence
  PIP-72 polypeptide
MGITVTNNSSNPIEVAINHWGSDGDTSFFGVGSGKQESWDRSDSRGFVLSLKKNGAQHPYYVQASSKIEVDNNAVKDQGRLIEPLS

SEQ ID NO: 636 - protein, 86 aa, Artificial Sequence
  PIP-72 polypeptide
MGITVTNNSSNPIEVAINHWGSDGDTSFFSVGNGKQETWDRSDSRGFVLSLKKNGAQAPYYVQASSKIEVDNNAVKDQGELIEPVS

SEQ ID NO: 637 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGRLIHPVA

SEQ ID NO: 638 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIHPLS

SEQ ID NO: 639 - protein, 86 aa, Artificial Sequence
  PIP-72 polypeptide
MGITVTNNSSKPIEVAINKWGSDGDTSFFSVGNGKQETWDRSDSRGFVLSLKKNGAQHPYYVQASSKIEVDNNAVKDQGRLIEPLS

SEQ ID NO: 640 - protein, 86 aa, Artificial Sequence
  PIP-72 polypeptide
MGITVTNNSSNPIEVAINHWGSDGDTSFFGIGSGKQESWDRSDSRGFVLSLKKNGAQHPYYVQASSKIEVDNNAVKDQGRLIEPLS

SEQ ID NO: 641 - protein, 86 aa, Artificial Sequence
  PIP-72 polypeptide
MGITVTNNSSKKIEAAINKWGSDGDTSFFSVGNGKQETWDRSDSRGFVLSLKKNGAQHPYYVQATSKIEIENNTVKDQGRLIEPLS

SEQ ID NO: 642 - protein, 86 aa, Artificial Sequence
  PIP-72 polypeptide
MGITVTNNSSNPIEVAINKWGSDGDTSFFSVGNGKQETWDRSDSRGFVLSLKRNGAQAPYYVQATSKIEIENNTVKDQGRLIEPLS

SEQ ID NO: 643 - protein, 86 aa, Artificial Sequence
  PIP-72 polypeptide
MGITVTNNSSNPIEVAINHWGSDGDTSFFGIDSGKQESWDRSDSRGFVLSLKKNGAQHPYYVQASSKIEVDNNAVKDQGRLIEPLS

SEQ ID NO: 644 - protein, 86 aa, Artificial Sequence
  PIP-72 polypeptide
MGITVTNNSSKKIEAAINKWGSDGDTSFFSVGNGKQETWDRSDSRGFVLSLKKNGAQHPYYVQASSKIEVDNNAVKDQGRLIEPLS

SEQ ID NO: 645 - protein, 86 aa, Artificial Sequence
  PIP-72 polypeptide
MGITVTNNSSKKIEAAINKWGSDGDTSFFGIDSGKQESWDRSDSRGFVLSLKKNGAQHPYYVQASSKIEVDNNAVKDQGRLIEPLS

SEQ ID NO: 646 - protein, 86 aa, Artificial Sequence
  PIP-72 polypeptide
MGITVTNNSSKKIEAAINKWGSDGDTSFFSVGNGKQETWDRSDSRGFVLSLKSNGAQHPYYVQASSKIEVDNNAVKDQGRLIEPLS

SEQ ID NO: 647 - protein, 86 aa, Artificial Sequence
  PIP-72 polypeptide
MGITVTNNSSKKIEAAINKWGSDGDTSFFSVGNGKQESWDRSDSRGFVLSLKRNGAQAPYYVQATSKIEIENNTVKDQGRLIEPLS

SEQ ID NO: 648 - protein, 86 aa, Artificial Sequence
  PIP-72 polypeptide
MGITVTNNSSKKIEAAINKWGSDGDTSFFGIDSGKQESWDRSDSRGFVLSLKKNGAQHPYYVQATSKIEIENNTVKDQGRLIEPLS

SEQ ID NO: 649 - protein, 86 aa, Artificial Sequence
  PIP-72 polypeptide
MGITVTNNSSNPIEVAINHWGSDGDTSFFGIDSGKQESWDRSDSRGFVLSLKRNGAQAPYYVQASSKIEVDNNAVKDQGRLIEPLS

SEQ ID NO: 650 - protein, 86 aa, Artificial Sequence
  PIP-72 polypeptide
MGITVTNNSSNPIEVAINHWGSDGDTSFFSVGNGKQESWDRSDSRGFVLSLKKNGAQHPYYVQASSKIEVDNNAVKDQGRLIEPLS

SEQ ID NO: 651 - protein, 86 aa, Artificial Sequence
  PIP-72 polypeptide
MGITVTNNSSNPIEAAINKWGSDGDTSFFSVGNGKQETWDRSDSRGFVLSLKKNGAQHPYYVQASSKIEVDNNAVKDQGRLIEPLS

SEQ ID NO: 652 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEVDNNAVKDQGRLIEPLS

SEQ ID NO: 653 - protein, 86 aa, Artificial Sequence
  PIP-72 polypeptide
MGITVTNNSSNPIEVAINHWGSDGDTSFFSVGNGKQESWDRSDSRGFVLSLKKNGAQAPYYVQASSKIEVDNNAVKDQGRLIEPLS

SEQ ID NO: 654 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEVDNNTVKDQGRLIEPLS

SEQ ID NO: 655 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGRLIEPLS

SEQ ID NO: 656 - protein, 86 aa, Artificial Sequence
  PIP-72 polypeptide
MGITVTNNSSKKIEAAINKWGSDGDTSFFGIDSGKQESWDRSDSRGFVLSLKRNGAQAPYYVQASSKIEVDNNAVKDQGRLIEPLS

SEQ ID NO: 657 - protein, 86 aa, Artificial Sequence
  PIP-72 polypeptide
MGITVTNNSSNPIEVAINHWGSDGDTSFFSVGNGKQETWDRSDSRGFVLSLKKNGAQAPYYVQASSKIEVDNNAVKDQGRLIEPLS

SEQ ID NO: 658 - protein, 86 aa, Artificial Sequence
  PIP-72 polypeptide
MGITVTNNSSNPIEVAINHWGSDGDTSFFGIDSGKQESWDRSDSRGFVLSLKKNGAQHPYYVQATSKIEIENNTVKDQGRLIEPLS

SEQ ID NO: 659 - protein, 86 aa, Artificial Sequence
  PIP-72 polypeptide
MGITVTNNSSKKIEAAINKWGSDGDTSFFSVGNGKQESWDRSDSRGFVLSLKKNGAQAPYYVQASSKIEVDNNAVKDQGRLIEPLS

SEQ ID NO: 660 - protein, 86 aa, Artificial Sequence
  PIP-72 polypeptide
MGITVTNNSSKKIEAAINKWGSDGDTSFFGIDSGKQETWDRSDSRGFVLSLKRNGAQAPYYVQASSKIEVDNNAVKDQGRLIEPLS

SEQ ID NO: 661 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQATSKIEIENNTVKDQGRLIEPLS

SEQ ID NO: 662 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQATSKIEIENNTVKDQGRLIEPLS

SEQ ID NO: 663 - protein, 86 aa, Artificial Sequence
  PIP-72 polypeptide
MGITVTNNSSKKIEAAINKWGSDGDTSFFSVGSGKQESWDRSDSRGFVLSLKKNGAQHPYYVQASSKIEVDNNAVKDQGRLIEPLS

SEQ ID NO: 664 - protein, 86 aa, Artificial Sequence
  PIP-72 polypeptide
MGITVTNNSSNPIEVAINHWGSDGDTSFFSVGNGKQETWDRSDSRGFVLSLKRNGAQAPYYVQASSKIEIENNTVKDQGRLIEPLS

SEQ ID NO: 665 - protein, 86 aa, Artificial Sequence
  PIP-72 polypeptide
MGITVTNNSSNPIEVAINHWGSDGDTSFFGIDSGKQESWDRSDSRGFVLSLKRNGAQAPYYVQASSKIEVDNNTVKDQGRLIEPLS

SEQ ID NO: 666 - protein, 86 aa, Artificial Sequence
  PIP-72 polypeptide
MGITVTNNSSKKIEAAINKWGSDGDTSFFSVGNGKQETWDRSDSRGFVLSLKRNGAQAPYYVQASSKIEVDNNAVKDQGRLIEPLS

SEQ ID NO: 667 - protein, 86 aa, Artificial Sequence
  PIP-72 polypeptide
MGITVTNNSSNPIEVAINHWGSDGDTSFFSVGNGKQETWDRSDSRGFVLSLKSNGAQAPYYVQASSKIEVDNNAVKDQGRLIEPLS

SEQ ID NO: 668 - protein, 86 aa, Artificial Sequence
  PIP-72 polypeptide
MGITVTNNSSKKIEAAINKWGSDGDTSFFGIDSGKQESWDRSDSRGFVLSLKRNGAQAPYYVQASSKIEVDNNAVKDQGELIHPVA

SEQ ID NO: 669 - protein, 86 aa, Artificial Sequence
  PIP-72 polypeptide
MGITVTNNSSKKIEAAINKWGSDGDTSFFGIDSGKQESWDRSDSRGFVLSLKRNGAQAPYYVQATSKIEIENNTVKDQGRLIEPLS

SEQ ID NO: 670 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGELIEPLA

SEQ ID NO: 671 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIEPVS

SEQ ID NO: 672 - protein, 86 aa, Artificial Sequence
  PIP-72 polypeptide
MGITVTNNSSNPIEVAINKWGSDGDTSFFSVGNGKQETWDRSDSRGFVLSLKKNGAQHPYYVQASSKIEVDNNAVKDQGRLIEPLS

SEQ ID NO: 673 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGRLIHPVS

SEQ ID NO: 674 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGRLIEPLS

SEQ ID NO: 675 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIHPVA

SEQ ID NO: 676 - protein, 86 aa, Artificial Sequence
  PIP-72 polypeptide
MGITVTNNSSKPIEVAINHWGSDGDTSFFSVGNGKQETWDRSDSRGFVLSLKKNGAQAPYYVQASSKIEVDNNAVKDQGELIEPVA

SEQ ID NO: 677 - protein, 86 aa, Artificial Sequence
  PIP-72 polypeptide
MGITVTNNSSKKIEAAINHWGSDGDTSFFSVGNGKQETWDRSDSRGFVLSLKKNGAQHPYYVQASSKIEVDNNAVKDQGRLIEPLS

SEQ ID NO: 678 - protein, 86 aa, Artificial Sequence
  PIP-72 polypeptide
MGITVTNNSSKPIEVAINHWGSDGDTSFFSVGNGKQETWDRSDSRGFVLSLKKNGAQHPYYVQASSKIEVDNNAVKDQGELIEPLA

SEQ ID NO: 679 - protein, 86 aa, Artificial Sequence
  PIP-72 polypeptide
MGITVTNNSSKPIEAAINHWGSDGDTSFFSVGNGKQETWDRSDSRGFVLSLKKNGAQHPYYVQASSKIEVDNNAVKDQGRLIEPLS

SEQ ID NO: 680 - protein, 86 aa, Artificial Sequence
  PIP-72 polypeptide
MGITVTNNSSKPIEAAINKWGSDGDTSFFSVGNGKQETWDRSDSRGFVLSLKKNGAQHPYYVQASSKIEVDNNAVKDQGRLIEPLS

SEQ ID NO: 681 - protein, 86 aa, Artificial Sequence
  PIP-72 polypeptide
MGITVTNNSSNKIEVAINHWGSDGDTSFFSVGNGKQETWDRSDSRGFVLSLKKNGAQHPYYVQASSKIEVDNNAVKDQGRLIEPLS

SEQ ID NO: 682 - protein, 86 aa, Artificial Sequence
  PIP-72 polypeptide
MGITVTNNSSNKIEAAINKWGSDGDTSFFSVGNGKQETWDRSDSRGFVLSLKKNGAQHPYYVQASSKIEVDNNAVKDQGRLIEPLS

SEQ ID NO: 683 - protein, 86 aa, Artificial Sequence
  PIP-72 polypeptide
MGITVTNNSSNKIEAAINHWGSDGDTSFFSVGNGKQETWDRSDSRGFVLSLKKNGAQHPYYVQASSKIEVDNNAVKDQGRLIEPLS

SEQ ID NO: 684 - protein, 86 aa, Artificial Sequence
  PIP-72 polypeptide
MGITVTNNSSNPIEAAINHWGSDGDTSFFSVGNGKQETWDRSDSRGFVLSLKKNGAQHPYYVQASSKIEVDNNAVKDQGRLIEPLS

SEQ ID NO: 685 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGELIEPLS

SEQ ID NO: 686 - protein, 86 aa, Artificial Sequence
  PIP-72 polypeptide
MGITVTNNSSNPIEVAINKWGSDGDTSFFSVGNGKQETWDRSDSRGFVLSLKRNGAQHPYYVQASSKIEVDNNAVKDQGRLIEPLS

SEQ ID NO: 687 - protein, 86 aa, Artificial Sequence
  PIP-72 polypeptide
MGITVTNNSSNPIEVAINHWGSDGDTSFFSVGNGKQETWDRSDSRGFVLSLKKNGAQHPYYVQASSKIEVDNNAVKDQGRLIHPVS

SEQ ID NO: 688 - protein, 86 aa, Artificial Sequence
  PIP-72 polypeptide
MGITVTNNSSNPIEVAINHWGSDGDTSFFSVGSGKQESWDRSDSRGFVLSLKKNGAQHPYYVQASSKIEVDNNAVKDQGRLIEPLS

SEQ ID NO: 689 - protein, 86 aa, Artificial Sequence
  PIP-72 polypeptide
MGITVTNNSSNPIEVAINHWGSDGDTSFFGIDSGKQESWDRSDSRGFVLSLKRNGAQHPYYVQASSKIEVDNNAVKDQGRLIEPLS

SEQ ID NO: 690 - protein, 86 aa, Artificial Sequence
  PIP-72 polypeptide
MGITVTNNSSNPIEVAINHWGSDGDTSFFSIDNGKQESWDRSDSRGFVLSLKKNGAQHPYYVQASSKIEVDNNAVKDQGELIEPVS

SEQ ID NO: 691 - protein, 86 aa, Artificial Sequence
  PIP-72 polypeptide
MGITVTNNSSNPIEVAINHWGSDGDTSFFSVGNGKQETWDRSDSRGFVLSLKRNGAQHPYYVQASSKIEVDNNAVKDQGELIEPLA

SEQ ID NO: 692 - protein, 86 aa, Artificial Sequence
  PIP-72 polypeptide
MGITVTNNSSNPIEVAINHWGSDGDTSFFGVGSGKQETWDRSDSRGFVLSLKKNGAQHPYYVQASSKIEVDNNAVKDQGELIEPLA

SEQ ID NO: 693 - protein, 86 aa, Artificial Sequence
  PIP-72 polypeptide
MGITVTNNSSNPIEVAINHWGSDGDTSFFSVDNGKQETWDRSDSRGFVLSLKRNGAQHPYYVQASSKIEVDNNAVKDQGELIHPLS

SEQ ID NO: 694 - protein, 86 aa, Artificial Sequence
  PIP-72 polypeptide
MGITVTNNSSNPIEVAINHWGSDGDTSFFGIDSGKQETWDRSDSRGFVLSLKKNGAQHPYYVQASSKIEVDNNAVKDQGRLIEPLS

SEQ ID NO: 695 - protein, 86 aa, Artificial Sequence
  PIP-72 polypeptide
MGITVTNNSSNPIEVAINHWGSDGDTSFFGVGNGKQETWDRSDSRGFVLSLKRNGAQHPYYVQASSKIEVDNNAVKDQGRLIEPLS

SEQ ID NO: 696 - protein, 86 aa, Artificial Sequence
  PIP-72 polypeptide
MGITVTNNSSNPIEVAINHWGSDGDTSFFSVGSGKQETWDRSDSRGFVLSLKRNGAQHPYYVQASSKIEVDNNAVKDQGELIEPLA

SEQ ID NO: 697 - protein, 86 aa, Artificial Sequence
  PIP-72 polypeptide
MGITVTNNSSNPIEVAINHWGSDGDTSFFGVGNGKQETWDRSDSRGFVLSLKKNGAQHPYYVQASSKIEVDNNAVKDQGRLIEPLS

SEQ ID NO: 698 - protein, 86 aa, Artificial Sequence
  PIP-72 polypeptide
MGITVTNNSSNPIEVAINHWGSDGDTSFFGIDSGKQETWDRSDSRGFVLSLKRNGAQHPYYVQASSKIEVDNNAVKDQGRLIEPLS

SEQ ID NO: 699 - protein, 86 aa, Artificial Sequence
  PIP-72 polypeptide
MGITVTNNSSNPIEVAINHWGSDGDTSFFSVGNGKQETWDRSDSRGFVLSLKHNGAQPPYYVQASSKIEVDNNAVKDQGRLIHPLA

SEQ ID NO: 700 - protein, 86 aa, Artificial Sequence
  PIP-72 polypeptide
MGITVTNNSSNPIEVAINHWGSDGDTSFFSVDSGKQESWDRSDSRGFVLSLKKNGAQHPYYVQASSKIEVDNNAVKDQGRLIEPVA

SEQ ID NO: 701 - protein, 86 aa, Artificial Sequence
  PIP-72 polypeptide
MGITVTNNSSNPIEVAINHWGSDGDTSFFSVGSGKQETWDRSDSRGFVLSLKKNGAQHPYYVQASSKIEVDNNAVKDQGRLIEPLS

SEQ ID NO: 702 - protein, 86 aa, Artificial Sequence
  PIP-72 polypeptide
MGITVTNNSSNPIEVAINHWGSDGDTSFFSVGSGKQESWDRSDSRGFVLSLKRNGAQAPYYVQASSKIEVDNNAVKDQGELIEPLS

SEQ ID NO: 703 - protein, 86 aa, Artificial Sequence
  PIP-72 polypeptide
MGITVTNNSSNPIEVAINHWGSDGDTSFFGIGSGKQESWDRSDSRGFVLSLKRNGAQAPYYVQASSKIEVDNNAVKDQGELIEPVS

SEQ ID NO: 704 - protein, 86 aa, Artificial Sequence
  PIP-72 polypeptide
MGITVTNNSSNPIEVAINHWGSDGDTSFFSVDNGKQETWDRSDSRGFVLSLKKNGAQHPYYVQASSKIEVDNNAVKDQGRLIEPLS

SEQ ID NO: 705 - protein, 86 aa, Artificial Sequence
  PIP-72 polypeptide
MGITVTNNSSNPIEVAINHWGSDGDTSFFGVDSGKQETWDRSDSRGFVLSLKKNGAQHPYYVQASSKIEVDNNAVKDQGRLIEPVA

SEQ ID NO: 706 - protein, 86 aa, Artificial Sequence
  PIP-72 polypeptide
MGITVTNNSSNPIEVAINHWGSDGDTSFFGIGNGKQESWDRSDSRGFVLSLKKNGAQHPYYVQASSKIEVDNNAVKDQGRLIEPLS

SEQ ID NO: 707 - protein, 86 aa, Artificial Sequence
  PIP-72 polypeptide
MGITVTNNSSNPIEVAINHWGSDGDTSFFGVDSGKQESWDRSDSRGFVLSLKKNGAQAPYYVQASSKIEVDNNAVKDQGRLIEPLS

SEQ ID NO: 708 - protein, 86 aa, Artificial Sequence
  PIP-72 polypeptide
MGITVTNNSSNPIEVAINHWGSDGDTSFFGVGSGKQETWDRSDSRGFVLSLKKNGAQAPYYVQASSKIEVDNNAVKDQGRLIEPLS

SEQ ID NO: 709 - protein, 86 aa, Artificial Sequence
  PIP-72 polypeptide
MGITVTNKSSKKIEASINKWGSDGDTKFFGIDSGKQESWDRSDDRGFVLSLKRNGAQAPYYVQATSKIEIENSTVKDHGETIHPVA

SEQ ID NO: 710 - protein, 86 aa, Artificial Sequence
  PIP-72 polypeptide
MGITVTNKSSKKIEASINKWGSDGDTKFFGIDSGKQESWDRSDDRGFVLSLKKNGTQAPYYVQATSKIEIENSTVKDHGETIHPVA

SEQ ID NO: 711 - protein, 86 aa, Artificial Sequence
  PIP-72 polypeptide
MGITVTNKSSKKIEASINKWGSDGDTKFFGIDSGKQESWDRSDDRGFVLSLKKNGAQAPYYVQATSKIEIENSTVKDHGETIHPVA

SEQ ID NO: 712 - protein, 86 aa, Artificial Sequence
  PIP-72 polypeptide
MGITVTNKSSKKIEASINKWGSDGDTKFFGIDSGKQESWDRSDDRGFVLSLKKNGAQAPYYVQATSKIEIENSTVKDQGRLIHPVS

SEQ ID NO: 713 - protein, 86 aa, Artificial Sequence
  PIP-72 polypeptide
MGITVTNNSSKPIEAAINHWGSDGDTKFFGIDSGKQESWDRSDDRGFVLSLKKNGAQHPYYVQATSKIEIENSTVKDHGETIHPVA

SEQ ID NO: 714 - protein, 86 aa, Artificial Sequence
  PIP-72 polypeptide
MGITVTNNSSKPIEAAINKWGSDGDTKFFGIDSGKQESWDRSDDRGFVLSLKRNGAQAPYYVQATSKIEIENSTVKDHGETIHPVA

SEQ ID NO: 715 - protein, 86 aa, Artificial Sequence
  PIP-72 polypeptide
MGITVTNNSSKPIEAAINKWGSDGDTKFFGIDSGKQESWDRSDDRGFVLSLKRNGAQAPYYVQATSKIEIENSTVKDQGELIHPVS

SEQ ID NO: 716 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDHGELIEPVA

SEQ ID NO: 717 - protein, 86 aa, Artificial Sequence
  PIP-72 polypeptide
MGITVTNKSSKKIEASINKWGSDGDTKFFGIDSGKQESWDRSDDRGFVLSLKKNGAQHPYYVQATSKIEIENSTVKDHGETIHPVA

SEQ ID NO: 718 - protein, 86 aa, Artificial Sequence
  PIP-72 polypeptide
MGITVTNKSSKKIEASINKWGSDGDTKFFGIDSGKQESWDRSDDRGFVLSLKRNGTQAPYYVQATSKIEIENSTVKDQGELIEPLA

SEQ ID NO: 719 - protein, 86 aa, Artificial Sequence
  PIP-72 polypeptide
MGITVTNNSSNKIEAAINKWGSDGDTKFFGIDSGKQESWDRSDDRGFVLSLKRNGTQAPYYVQATSKIEIENSTVKDHGETIHPVA

SEQ ID NO: 720 - protein, 86 aa, Artificial Sequence
  PIP-72 polypeptide
MGITVTNKSSKKIEASINKWGSDGDTKFFGIDSGKQESWDRSDDRGFVLSLKRNGAQAPYYVQATSKIEIENSTVKDQGELIHPVA

SEQ ID NO: 721 - protein, 86 aa, Artificial Sequence
  PIP-72 polypeptide
MGITVTNKSSKKIEASINKWGRDGDTKFFGIDSGKQESWDRSDDRGFVLSLKRNGTQAPYYVQATSKIEIENSTVKDQGRLIHPVA

SEQ ID NO: 722 - protein, 86 aa, Artificial Sequence
  PIP-72 polypeptide
MGITVTNKSSKKIEASINKWGSDGDTSFFSIGSGKQETWDRSDDRGFVLSLKRNGAQHPYYVQATSKIEIENSTVKDHGETIHPVA

SEQ ID NO: 723 - protein, 86 aa, Artificial Sequence
  PIP-72 polypeptide
MGITVTNKSSKKIEASINKWGSDGDTSFFGVGSGKQETWDRSDDRGFVLSLKRNGTQAPYYVQATSKIEIENSTVKDHGETIHPVA

SEQ ID NO: 724 - protein, 86 aa, Artificial Sequence
  PIP-72 polypeptide
MGITVTNKSSKKIEASINKWGSDGDTSFFGVDSGKQETWDRSDDRGFVLSLKRNGTQAPYYVQATSKIEIENSTVKDHGETIHPVA

SEQ ID NO: 725 - protein, 86 aa, Artificial Sequence
  PIP-72 polypeptide
MGITVTNKSSKKIEASINKWGSDGDTSFFGVDSGKQESWDRSDDRGFVLSLKRNGTQAPYYVQATSKIEIENSTVKDHGETIHPVA

SEQ ID NO: 726 - protein, 86 aa, Artificial Sequence
  PIP-72 polypeptide
MGITVTNKSSKKIEASINKWGSDGDTKFFGIDSGKQESWDRSDSRGFVLSLKRNGTQAPYYVQATSKIEIENSTVKDHGETIHPVA

SEQ ID NO: 727 - protein, 86 aa, Artificial Sequence
  PIP-72 polypeptide
MGITVTNKSSKKIEASINKWGSDGDTSFFGVGSGKQESWDRSDDRGFVLSLKRNGTQAPYYVQATSKIEIENSTVKDHGETIHPVA

SEQ ID NO: 728 - protein, 86 aa, Artificial Sequence
  PIP-72 polypeptide
MGITVTNKSSKKIEASINKWGSDGDTSFFSIDSGKQETWDRSDDRGFVLSLKRNGAQHPYYVQATNKIEIENSTVKDHGETIHPVA

SEQ ID NO: 729 - protein, 86 aa, Artificial Sequence
  PIP-72 polypeptide
MGITVTNKSSKKIEASINKWGSDGDTKFFGIDSGKQETWDRSDDRGFVLSLKRNGTQAPYYVQATSKIEIENSTVKDHGETIHPVA

SEQ ID NO: 730 - protein, 86 aa, Artificial Sequence
  PIP-72 polypeptide
MGITVTNKSSKKIEASINKWGSDGDTKFFGIDSGKQETWDRSDSRGFVLSLKRNGAQAPYYVQATSKIEIENSTVKDHGETIHPVA

SEQ ID NO: 731 - protein, 86 aa, Artificial Sequence
  PIP-72 polypeptide
MGITVTNKSSKKIEASINKWGSDGDTKFFGIDSGKQETWDRSDDRGFVLSLKRNGAQAPYYVQATSKIEIENSTVKDQGELIHPVS

SEQ ID NO: 732 - protein, 86 aa, Artificial Sequence
  PIP-72 polypeptide
MGITVTNKSSKKIEASINKWGSDGDTKFFGVGSGKQETWDRSDDRGFVLSLKRNGTQAPYYVQATSKIEIENSTVKDQGELIEPLS

SEQ ID NO: 733 - protein, 86 aa, Artificial Sequence
  PIP-72 polypeptide
MGITVTNKSSKKIEASINKWGSDGDTSFFGVDSGKQETWDRSDDRGFVLSLKRNGAQHPYYVQATSKIEIENSTVKDHGETIHPVA

SEQ ID NO: 734 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDQGELIHPVA

SEQ ID NO: 735 - protein, 86 aa, Artificial Sequence
  PIP-72 polypeptide
MGITVTNKSSKKIEASINKWGSDGDTSFFSVGSGKQETWDRSDDRGFVLSLKRNGAQAPYYVQATSKIEIENSTVKDHGETIHPVA

SEQ ID NO: 736 - protein, 86 aa, Artificial Sequence
  PIP-72 polypeptide
MGITVTNNSSNPIEVAINKWGSDGDTKFFGIDSGKQESWDRSDDRGFVLSLKRNGAQHPYYVQATSKIEIENSTVKDHGETIHPVA

SEQ ID NO: 737 - protein, 86 aa, Artificial Sequence
  PIP-72 polypeptide
MGITVTNNSSNKIEAAINKWGSDGDTKFFGIDSGKQESWDRSDDRGFVLSLKRNGAQAPYYVQATSKIEIENSTVKDHGETIHPVA

SEQ ID NO: 738 - protein, 86 aa, Artificial Sequence
  PIP-72 polypeptide
MGITVTNNSSNPIEVAINKWGSDGDTKFFGIDSGKQESWDRSDDRGFVLSLKRNGTQAPYYVQASSKIEIENNAVKDQGETIHPVA

SEQ ID NO: 739 - protein, 86 aa, Artificial Sequence
  PIP-72 polypeptide
MGITVTNKSSKKIEASINKWGSDGDTKFFGIDSGKQESWDRSDDRGFVLSLKKNGAQAPYYVQATSKIEIENSTVKDQGELIHPLA

SEQ ID NO: 740 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDHGETIHPVA

SEQ ID NO: 741 - protein, 86 aa, Artificial Sequence
  PIP-72 polypeptide
MGITVTNNSSKKIEAAINKWGSDGDTKFFGIDSGKQESWDRSDDRGFVLSLKKNGAQHPYYVQATSKIEIENSTVKDHGETIHPVA

SEQ ID NO: 742 - protein, 86 aa, Artificial Sequence
  PIP-72 polypeptide
MGITVTNNSSKPIEAAINHWGSDGDTKFFGIDSGKQESWDRSDDRGFVLSLKRNGAQAPYYVQATSKIEIENSTVKDHGETIHPVA

SEQ ID NO: 743 - protein, 86 aa, Artificial Sequence
  PIP-72 polypeptide
MGITVTNNSSKPIEAAINHWGSDGDTKFFGIDSGKQESWDRSDDRGFVLSLKRNGTQAPYYVQATSKIEIENSTVKDHGETIHPVA

SEQ ID NO: 744 - protein, 86 aa, Artificial Sequence
  PIP-72 polypeptide
MGITVTNKSSKKIEASINKWGSDGDTSFFGIDSGKQESWDRSDDRGFVLSLKKNGAQAPYYVQATSKIEIENSTVKDHGETIHPVA

SEQ ID NO: 745 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEVENNAVKDHGETIHPVA

SEQ ID NO: 746 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIDNNTVKDHGETIHPVA

SEQ ID NO: 747 - protein, 86 aa, Artificial Sequence
  PIP-72 polypeptide
MGITVTNNSSKKIEAAINHWGSDGDTKFFGIDSGKQESWDRSDDRGFVLSLKRNGTQAPYYVQATSKIEIENSTVKDHGETIHPVA

SEQ ID NO: 748 - protein, 86 aa, Artificial Sequence
  PIP-72 polypeptide
MGITVTNNSSKPIEAAINKWGSDGDTKFFGIDSGKQESWDRSDDRGFVLSLKRNGAQAPYYVQATSKIEIENSTVKDQGRLIHPLS

SEQ ID NO: 749 - protein, 86 aa, Artificial Sequence
  PIP-72 polypeptide
MGITVTNNSSKPIEAAINKWGSDGDTSFFSVDSGKQETWDRSDDRGFVLSLKRNGAQAPYYVQATSKIEIENSTVKDHGETIHPVA

SEQ ID NO: 750 - protein, 86 aa, Artificial Sequence
  PIP-72 polypeptide
MGITVTNKSSKKIEAAINKWGSDGDTSFFGVGSGKQETWDRSDDRGFVLSLKRNGTQAPYYVQATSKIEIENSTVKDHGETIHPVA

SEQ ID NO: 751 - protein, 86 aa, Artificial Sequence
  PIP-72 polypeptide
MGITVTNNSSNPIEVAINKWGSDGDTKFFGIGSGKQESWDRSDDRGFVLSLKRNGAQHPYYVQATSKIEIENSTVKDHGETIHPVA

SEQ ID NO: 752 - protein, 86 aa, Artificial Sequence
  PIP-72 polypeptide
MGITVTNKSSKKIEASINKWGSDGDTKFFGIDSGKQESWDRSDDRGFVLSLKSNGAQAPYYVQATSKIEIENSTVKDHGETIHPVA

SEQ ID NO: 753 - protein, 86 aa, Artificial Sequence
  PIP-72 polypeptide
MGITVTNKSSKKIEASINKWGSDGDTSFFGVGSGKQETWDRSDDRGFVLSLKKNGAQHPYYVQATSKIEIENSTVKDQGETIHPVA

SEQ ID NO: 754 - protein, 86 aa, Artificial Sequence
  PIP-72 polypeptide
MGITVTNKSSKKIEAAINKWGSDGDTKFFGIDSGKQESWDRSDDRGFVLSLKKNGAQHPYYVQASSKIEIENNTVKDHGETIHPVA

SEQ ID NO: 755 - protein, 86 aa, Artificial Sequence
  PIP-72 polypeptide
MGITVTNKSSKKIEASINHWGSDGDTSFFGIDSGKQESWDRSDDRGFVLSLKRNGAQHPYYVQATSKIEIENSTVKDHGETIHPVA

SEQ ID NO: 756 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENNAVKDQGRLIEPVA

SEQ ID NO: 757 - protein, 86 aa, Artificial Sequence
  PIP-72 polypeptide
MGITVTNNSSKPIEVAINHWGSDGDTKFFGIDSGKQESWDRSDDRGFVLSLKRNGTQAPYYVQATSKIEIENSTVKDHGETIHPVA

SEQ ID NO: 758 - protein, 86 aa, Artificial Sequence
  PIP-72 polypeptide
MGITVTNKSSKKIEAAINKWGSDGDTKFFGIDSGKQESWDRSDDRGFVLSLKKNGAQHPYYVQATSKIEIENSTVKDHGETIHPVA

SEQ ID NO: 759 - protein, 86 aa, Artificial Sequence; identical to SEQ ID NO: 714
  PIP-72 polypeptide

SEQ ID NO: 760 - protein, 86 aa, Artificial Sequence
  PIP-72 polypeptide
MGITVTNKSSKKIEASINKWGSDGDTKFFGIDSGKQESWDRSDDRGFVLSLKRNGAQHPYYVQATSKIEIENSTVKDQGELIHPVS

SEQ ID NO: 761 - protein, 86 aa, Artificial Sequence
  PIP-72 polypeptide
MGITVTNKSSKKIEASINKWGSDGDTKFFGIDSGKQETWDRSDDRGFVLSLKRNGAQHPYYVQATSKIEIENSTVKDHGETIHPVA

SEQ ID NO: 762 - protein, 86 aa, Artificial Sequence
  PIP-72 polypeptide
MGITVTNNSSKKIEVAINHWGSDGDTKFFGIDSGKQESWDRSDDRGFVLSLKRNGTQAPYYVQATSKIEIENSTVKDHGETIHPVA

SEQ ID NO: 763 - protein, 86 aa, Artificial Sequence; identical to SEQ ID NO: 717
  PIP-72 polypeptide

SEQ ID NO: 764 - protein, 86 aa, Artificial Sequence
  PIP-72 polypeptide
MGITVTNNSSKKIEVAINKWGSDGDTKFFGIDSGKQESWDRSDDRGFVLSLKRNGAQHPYYVQATSKIEIENSTVKDHGETIHPVA

SEQ ID NO: 765 - protein, 86 aa, Artificial Sequence
  PIP-72 polypeptide
MGITVTNKSSKKIEASINHWGSDGDTKFFGIDSGKQESWDRSDDRGFVLSLKKNGAQHPYYVQATSKIEIENSTVKDHGETIHPVA

SEQ ID NO: 766 - protein, 86 aa, Artificial Sequence
  PIP-72 polypeptide
MGITVTNNSSKKIEVAINKWGSDGDTKFFGIDSGKQESWDRSDDRGFVLSLKKNGAQHPYYVQATSKIEIENSTVKDHGETIHPVA

SEQ ID NO: 767 - protein, 86 aa, Artificial Sequence
  PIP-72 polypeptide
MGITVTNKSSKKIEASINKWGSDGDTKFFGIDSGKQETWDRSDDRGFVLSLKKNGAQAPYYVQATSKIEIENSTVKDHGETIHPVA

SEQ ID NO: 768 - protein, 86 aa, Artificial Sequence
  PIP-72 polypeptide
MGITVTNKSSKKIEVAINHWGSDGDTKFFGIDSGKQESWDRSDDRGFVLSLKRNGAQHPYYVQATSKIEIENSTVKDHGETIHPVA

SEQ ID NO: 769 - DNA, 261 bp, Artificial Sequence
  Coding sequence for PIP-72 polypeptide
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaagaagaatggcgcgcaacacccttactacgttcaggccagcagcaaaattgaagtcgacaacaacgccgtgaaagatcagggccggttgatcgagccgctctcgtaa

SEQ ID NO: 770 - DNA, 261 bp, Artificial Sequence
  Coding sequence for PIP-72 polypeptide
atgggtattaccgttaccaacaaatcatcgaaaaaaattgaagcctcgatcaacaaatggggtagcgacggcgacaccaagttcttcggaatcgatagcggcaagcaggaaagctgggaccgatcagacgaccgtggctttgtgctgtcactgaagaagaatggcgcgcaacacccttactacgttcaggccagcagcaaaattgaagtcgacaacaacgccgtgaaagaccacggcgaaaccatccacccggtcgcgtaa

SEQ ID NO: 771 - protein, 86 aa, Artificial Sequence
  PIP-72 polypeptide
MGITVTNKSSKKIEASINKWGSDGDTKFFGIDSGKQESWDRSDDRGFVLSLKKNGAQHPYYVQASSKIEVDNNAVKDQGRLIEPLS

SEQ ID NO: 772 - protein, 86 aa, Artificial Sequence
  PIP-72 polypeptide
MGITVTNKSSKKIEASINKWGSDGDTKFFGIDSGKQESWDRSDDRGFVLSLKKNGAQHPYYVQASSKIEVDNNAVKDHGETIHPVA

SEQ ID NO: 773 - DNA, 81 bp, Artificial Sequence
  mutagenesis primer
  misc_feature (29)..(29): s is g or c
  misc_feature (35)..(35): v is a, g or c
  misc_feature (52)..(52): r is a or g
  misc_feature (55)..(55): m is a or c
  misc_feature (61)..(61): m is a or c
gtcggtaacggcaagcagtgcggttgggscaggavcgacgcacgtggcttcrtcmtgtgtmtgaagaagaatggcgcgcaa

SEQ ID NO: 774 - DNA, 81 bp, Artificial Sequence
  mutagenesis primer
  misc_feature (29)..(29): s is g or c
  misc_feature (45)..(45): v is a, c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggscaggavcgacgcacgtggcttcrtcmtgdccmtgaagaagaatggcgcgcaa

SEQ ID NO: 775 - DNA, 81 bp, Artificial Sequence
  mutagenesis primer
  misc_feature (29)..(29): s is g or c
  misc_feature (35)..(35): v is a, c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcggttgggscaggavcgacarccgtggcttcrtcmtgtgtmtgaagaagaatggcgcgcaa

SEQ ID NO: 776 - DNA, 81 bp, Artificial Sequence
  mutagenesis primer
  misc_feature (29)..(29): s is g or c
  misc_feature (35)..(35): v is a, c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggscaggavcgacarccgtggcttcrtcmtgdccmtgaagaagaatggcgcgcaa

SEQ ID NO: 777 - DNA, 81 bp, Artificial Sequence
  mutagenesis primer
  misc_feature (30)..(30): w is a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcagtgcggttgggawaggavcgacgcacgtggcttcrtcmtgtgtmtgaagaagaatggcgcgcaa

SEQ ID NO: 778 - DNA, 81 bp, Artificial Sequence
  mutagenesis primer
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggawaggavcgacgcacgtggcttcrtcmtgdccmtgaagaagaatggcgcgcaa

SEQ ID NO: 779 - DNA, 81 bp, Artificial Sequence
  mutagenesis primer
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcggttgggawaggavcgacarccgtggcttcrtcmtgtgtmtgaagaagaatggcgcgcaa

SEQ ID NO: 780 - DNA, 81 bp, Artificial Sequence
  mutagenesis primer
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcggttgggawaggavcgacarccgtggcttcrtcmtgdccmtgaagaagaatggcgcgcaa

SEQ ID NO: 781 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcagtgcwcttgggscaggavcgacgcacgtggcttcrtcmtgtgtmtgaagaagaatggcgcgcaa

SEQ ID NO: 782 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggscaggavcgacgcacgtggcttcrtcmtgdccmtgaagaagaatggcgcgcaa

SEQ ID NO: 783 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcwcttgggscaggavcgacarccgtggcttcrtcmtgtgtmtgaagaagaatggcgcgcaa

SEQ ID NO: 784 - DNA, 81 bp, Artificial Sequence
  mutagenesis primer
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggscaggavcgacarccgtggcttcrtcmtgdccmtgaagaagaatggcgcgcaa

SEQ ID NO: 785 - DNA, 81 bp, Artificial Sequence
  mutagenesis primer
  misc_feature (22)..(22): w ir a or t
  misc_feature (30)..(30): w ir a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcagtgcwcttgggawaggavcgacgcacgtggcttcrtcmtgtgtmtgaagaagaatggcgcgcaa

SEQ ID NO: 786 - DNA, 81 bp, Artificial Sequence
  mutagenesis primer
  misc_feature (22)..(22): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggawaggavcgacgcacgtggcttcrtcmtgdccmtgaagaagaatggcgcgcaa

SEQ ID NO: 787 - DNA, 81 bp, Artificial Sequence
  mutagenesis primer
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcagtgcwcttgggawaggavcgacarccgtggcttcrtcmtgtgtmtgaagaagaatggcgcgcaa

SEQ ID NO: 788 - DNA, 81 bp, Artificial Sequence
  mutagenesis primer
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcagtgcwcttgggawaggavcgacarccgtggcttcrtcmtgdccmtgaagaagaatggcgcgcaa

SEQ ID NO: 789 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwggttgggscaggavcgacgcacgtggcttcrtcmtgtgtmtgaagaagaatggcgcgcaa

SEQ ID NO: 790 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwggttgggscaggavcgacgcacgtggcttcrtcmtgdccmtgaagaagaatggcgcgcaa

SEQ ID NO: 791 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwggttgggscaggavcgacarccgtggcttcrtcmtgtgtmtgaagaagaatggcgcgcaa

SEQ ID NO: 792 - DNA, 81 bp, Artificial Sequence
  mutagenesis primer
  misc_feature (20)..(20): w is a or t
  misc_feature (21)..(21): w is a or t
  misc_feature (29)..(29): s is g or c
  misc_feature (35)..(35): v is a, c or g
  misc_feature (41)..(41): r is a or g
  misc_feature (52)..(52): r is a or g
  misc_feature (55)..(55): m is a or c
  misc_feature (58)..(58): d is a, c or g
  misc_feature (61)..(61): m is a or c
gtcggtaacggcaagcaggwwggttgggscaggavcgacarccgtggcttcrtcmtgdccmtgaagaagaatggcgcgcaa

SEQ ID NO: 793 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwggttgggawaggavcgacgcacgtggcttcrtcmtgtgtmtgaagaagaatggcgcgcaa

SEQ ID NO: 794 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, c or g
  misc_feature (61)..(61): m is a or c
gtcggtaacggcaagcaggwwggttgggawaggavcgacgcacgtggcttcrtcmtgdccmtgaagaagaatggcgcgcaa

SEQ ID NO: 795 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwggttgggawaggavcgacarccgtggcttcrtcmtgtgtmtgaagaagaatggcgcgcaa

SEQ ID NO: 796 - DNA, 81 bp, Artificial Sequence
  mutagenesis primer
  misc_feature (20)..(20): w is a or t
  misc_feature (21)..(21): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwggttgggawaggavcgacarccgtggcttcrtcmtgdccmtgaagaagaatggcgcgcaa

SEQ ID NO: 797 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwwcttgggscaggavcgacgcacgtggcttcrtcmtgtgtmtgaagaagaatggcgcgcaa

SEQ ID NO: 798 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggscaggavcgacgcacgtggcttcrtcmtgdccmtgaagaagaatggcgcgcaa

SEQ ID NO: 799 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwwcttgggscaggavcgacarccgtggcttcrtcmtgtgtmtgaagaagaatggcgcgcaa

SEQ ID NO: 800 - DNA, 81 bp, Artificial Sequence
  mutagenesis primer
  misc_feature (20)..(29): w is a or t
  misc_feature (21)..(21): w is a or t
  misc_feature (22)..(22): w is a or t
  misc_feature (29)..(29): s is g or c
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggscaggavcgacarccgtggcttcrtcmtgdccmtgaagaagaatggcgcgcaa

SEQ ID NO: 801 - DNA, 81 bp, Artificial Sequence
  mutagenesis primer
  misc_feature (20)..(20): w is a or t
  misc_feature (21)..(21): w is a or t
  misc_feature (22)..(212): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (61)..(61): m is a or c
gtcggtaacggcaagcaggwwwcttgggawaggavcgacgcacgtggcttcrtcmtgtgtmtgaagaagaatggcgcgcaa

SEQ ID NO: 802 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (30)..(30): w is a or t
  misc_feature (35)..(35): v is a , c or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggawaggavcgacgcacgtggcttcrtcmtgdccmtgaagaagaatggcgcgcaa

SEQ ID NO: 803 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (61)..(61): m is a or c
gtcggtaacggcaagcaggwwwcttgggawaggavcgacarccgtggcttcrtcmtgtgtmtgaagaagaatggcgcgcaa

SEQ ID NO: 804 - DNA, 81 bp, Artificial Sequence
  mutagenesis primer
  misc_feature (20)..(20): w is a or t
  misc_feature (21)..(21): w is a or t
  misc_feature (22)..(22): w is a or t
  misc_feature (30)..(30): w is a or t
  misc_feature (35)..(35): v is a , c or g
  misc_feature (41)..(41): r is a or g
  misc_feature (52)..(52): r is a or g
  misc_feature (55)..(55): m is a or c
  misc_feature (58)..(58): d is a, g or t
  misc_feature (61)..(61): m is a or c
gtcggtaacggcaagcaggwwwcttgggawaggavcgacarccgtggcttcrtcmtgdccmtgaagaagaatggcgcgcaa

SEQ ID NO: 805 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaagttgggaaaggtccgacgcccgtggcttcgtgctttccctgaagaagaatggcgcgcaacacccttactacgttcaggccagcagcaaaattgaagtcgacaacaacgccgtgaaagatcagggccggttgatcgagccgctctcgtaa

SEQ ID NO: 806 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggttacttggggcaggagcgacgcacgtggcttcgtcctgggcctgaagaagaatggcgcgcaacacccttactacgttcaggccagcagcaaaattgaagtcgacaacaacgccgtgaaagatcagggccggttgatcgagccgctctcgtaa

SEQ ID NO: 807 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtcatgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 808 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaggttgggataggagcgacgcacgtggcttcgtcatgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 809 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctggggcaggaccgacaaccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 810 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacagccgtggcttcgtcctgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 811 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaacctgggacaggtccgacaaccgtggcttcgtcatgtccctgaagaagaatggcgcgcaacacccttactacgttcaggccagcagcaaaattgaagtcgacaacaacgccgtgaaagatcagggccggttgatcgagccgctctcgtaa

SEQ ID NO: 812 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtatcttgggccaggagcgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 813 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgcggttgggataggagcgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 814 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaggttgggataggagcgacgcacgtggcttcgtcatggccctgaagaagaatggcgcgcaacacccttactacgttcaggccagcagcaaaattgaagtcgacaacaacgccgtgaaagatcagggccggttgatcgagccgctctcgtaa

SEQ ID NO: 815 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaggttgggaaaggagcgacaaccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 816 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgcggttgggataggaccgacaaccgtggcttcgtcatgtccctgaagaagaatggcgcgcaacacccttactacgttcaggccagcagcaaaattgaagtcgacaacaacgccgtgaaagatcagggccggttgatcgagccgctctcgtaa

SEQ ID NO: 817 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtttcttggggcaggagcgacgcacgtggcttcatcctgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 818 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggaaggttgggataggaccgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 819 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggatacttgggccaggaccgacagccgtggcttcgtcatgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 820 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgcacttggggcaggagcgacagccgtggcttcgtcatggccctgaagaagaatggcgcgcaacacccttactacgttcaggccagcagcaaaattgaagtcgacaacaacgccgtgaaagatcagggccggttgatcgagccgctctcgtaa

SEQ ID NO: 821 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcagtgctcttgggaaaggaccgacagccgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 822 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtttcttgggccaggaacgacagccgtggcttcgtcctgtccctgaagaagaatggcgcgcaacacccttactacgttcaggccagcagcaaaattgaagtcgacaacaacgccgtgaaagatcagggccggttgatcgagccgctctcgtaa

SEQ ID NO: 823 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggtaacttgggaaaggaccgacaaccgtggcttcgtcatgtgtatgaagaagaatggcgcgcaacacccttactacgttcaggccagcagcaaaattgaagtcgacaacaacgccgtgaaagatcagggccggttgatcgagccgctctcgtaa

SEQ ID NO: 824 - DNA, 261 bp, Artificial Sequence
  Coding sequence for PIP-72 polypeptide
atgggtattaccgttacaaacaattcgtccaaccccatcgaagtcgccatcaatcattggggtagcgacggagacaccagcttcttttccgtcggtaacggcaagcaggattcttgggataggagcgacgcacgtggcttcgtcctgtgtctgaagaagaatggcgcgcaacacccttactacgttcaggccagcagcaaaattgaagtcgacaacaacgccgtgaaagatcagggccggttgatcgagccgctctcgtaa

SEQ ID NO: 825 - protein, 86 aa, Artificial Sequence
  PIP-72 polypeptide
MGITVTNNSSNPIEVAINHWGSDGDTSFFSVGNGKQVSWERSDARGFVLSLKKNGAQHPYYVQASSKIEVDNNAVKDQGRLIEPLS

SEQ ID NO: 826 - protein, 86 aa, Artificial Sequence
  PIP-72 polypeptide
MGITVTNNSSNPIEVAINHWGSDGDTSFFSVGNGKQVTWGRSDARGFVLGLKKNGAQHPYYVQASSKIEVDNNAVKDQGRLIEPLS

SEQ ID NO: 827 - protein, 86 aa, Artificial Sequence
  PIP-72 polypeptide
MGITVTNNSSNPIEVAINHWGSDGDTSFFSVGNGKQETWDRSDSRGFVMCMKKNGAQHPYYVQASSKIEVDNNAVKDQGRLIEPLS

SEQ ID NO: 828 - protein, 86 aa, Artificial Sequence
  PIP-72 polypeptide
MGITVTNNSSNPIEVAINHWGSDGDTSFFSVGNGKQEGWDRSDARGFVMCMKKNGAQHPYYVQASSKIEVDNNAVKDQGRLIEPLS

SEQ ID NO: 829 - protein, 86 aa, Artificial Sequence
  PIP-72 polypeptide
MGITVTNNSSNPIEVAINHWGSDGDTSFFSVGNGKQETWGRTDNRGFVLCLKKNGAQHPYYVQASSKIEVDNNAVKDQGRLIEPLS

SEQ ID NO: 830 - protein, 86 aa, Artificial Sequence
  PIP-72 polypeptide
MGITVTNNSSNPIEVAINHWGSDGDTSFFSVGNGKQETWDRSDSRGFVLCMKKNGAQHPYYVQASSKIEVDNNAVKDQGRLIEPLS

SEQ ID NO: 831 - protein, 86 aa, Artificial Sequence
  PIP-72 polypeptide
MGITVTNNSSNPIEVAINHWGSDGDTSFFSVGNGKQETWDRSDNRGFVMSLKKNGAQHPYYVQASSKIEVDNNAVKDQGRLIEPLS

SEQ ID NO: 832 - protein, 86 aa, Artificial Sequence
  PIP-72 polypeptide
MGITVTNNSSNPIEVAINHWGSDGDTSFFSVGNGKQVSWARSDSRGFVLCLKKNGAQHPYYVQASSKIEVDNNAVKDQGRLIEPLS

SEQ ID NO: 833 - protein, 86 aa, Artificial Sequence
  PIP-72 polypeptide
MGITVTNNSSNPIEVAINHWGSDGDTSFFSVGNGKQCGWDRSDSRGFVLCLKKNGAQHPYYVQASSKIEVDNNAVKDQGRLIEPLS

SEQ ID NO: 834 - protein, 86 aa, Artificial Sequence
  PIP-72 polypeptide
MGITVTNNSSNPIEVAINHWGSDGDTSFFSVGNGKQVGWDRSDARGFVMALKKNGAQHPYYVQASSKIEVDNNAVKDQGRLIEPLS

SEQ ID NO: 835 - protein, 86 aa, Artificial Sequence
  PIP-72 polypeptide
MGITVTNNSSNPIEVAINHWGSDGDTSFFSVGNGKQVGWERSDNRGFVLCLKKNGAQHPYYVQASSKIEVDNNAVKDQGRLIEPLS

SEQ ID NO: 836 - protein, 86 aa, Artificial Sequence
  PIP-72 polypeptide
MGITVTNNSSNPIEVAINHWGSDGDTSFFSVGNGKQCGWDRTDNRGFVMSLKKNGAQHPYYVQASSKIEVDNNAVKDQGRLIEPLS

SEQ ID NO: 837 - protein, 86 aa, Artificial Sequence
  PIP-72 polypeptide
MGITVTNNSSNPIEVAINHWGSDGDTSFFSVGNGKQVSWGRSDARGFILCMKKNGAQHPYYVQASSKIEVDNNAVKDQGRLIEPLS

SEQ ID NO: 838 - protein, 86 aa, Artificial Sequence
  PIP-72 polypeptide
MGITVTNNSSNPIEVAINHWGSDGDTSFFSVGNGKQEGWDRTDSRGFVLCLKKNGAQHPYYVQASSKIEVDNNAVKDQGRLIEPLS

SEQ ID NO: 839 - protein, 86 aa, Artificial Sequence
  PIP-72 polypeptide
MGITVTNNSSNPIEVAINHWGSDGDTSFFSVGNGKQDTWARTDSRGFVMCLKKNGAQHPYYVQASSKIEVDNNAVKDQGRLIEPLS

SEQ ID NO: 840 - protein, 86 aa, Artificial Sequence
  PIP-72 polypeptide
MGITVTNNSSNPIEVAINHWGSDGDTSFFSVGNGKQCTWGRSDSRGFVMALKKNGAQHPYYVQASSKIEVDNNAVKDQGRLIEPLS

SEQ ID NO: 841 - protein, 86 aa, Artificial Sequence
  PIP-72 polypeptide
MGITVTNNSSNPIEVAINHWGSDGDTSFFSVGNGKQCSWERTDSRGFVLCLKKNGAQHPYYVQASSKIEVDNNAVKDQGRLIEPLS

SEQ ID NO: 842 - protein, 86 aa, Artificial Sequence
  PIP-72 polypeptide
MGITVTNNSSNPIEVAINHWGSDGDTSFFSVGNGKQVSWARNDSRGFVLSLKKNGAQHPYYVQASSKIEVDNNAVKDQGRLIEPLS

SEQ ID NO: 843 - protein, 86 aa, Artificial Sequence
  PIP-72 polypeptide
MGITVTNNSSNPIEVAINHWGSDGDTSFFSVGNGKQVTWERTDNRGFVMCMKKNGAQHPYYVQASSKIEVDNNAVKDQGRLIEPLS

SEQ ID NO: 844 - protein, 86 aa, Artificial Sequence
  PIP-72 polypeptide
MGITVTNNSSNPIEVAINHWGSDGDTSFFSVGNGKQDSWDRSDARGFVLCLKKNGAQHPYYVQASSKIEVDNNAVKDQGRLIEPLS

SEQ ID NO: 845 - DNA, 261 bp, Artificial Sequence
  Coding sequence for PIP-72 polypeptide
atgggtattaccgttacaaacaaatcgtccaaaaaaatcgaagctagcatcaataaatggggtagcgacggagacaccaaattctttggcatcgatagcggcaagcaggaatcctgggacaggtccgacgaccgtggcttcgtgctttccctgaagcgtaatggcactcaagcaccttactacgttcaggccaccagcaaaattgaaattgaaaactctaccgtgaaagatcatggcgaaaccatccacccggtagcataa

SEQ ID NO: 846 - protein, 86 aa, Artificial Sequence
  test
  misc_feature (2)..(2): Xaa at position 2 is Gly, Ala, Cys, Asp, Glu, Ile, Lys, Leu, Asn, Arg, Ser, Thr, Val, Trp or Tyr
  misc_feature (3)..(3): Xaa at position 3 is Ile or Trp
  misc_feature (4)..(4): Xaa at position 4 is Thr, Ala, Asp, Glu, His, Ile, Lys, Leu, Arg, Ser, Val, Trp or Tyr
  misc_feature (5)..(5): Xaa at position 5 is Val, Ala, Cys, Gly, His, Ile or Tyr
  misc_feature (6)..(6): Xaa at position 6 is Thr, Ala, Cys, Phe, Gly, His, Ile, Lys, Met, Pro, Gln, Arg, Ser, Trp or Tyr
  misc_feature (7)..(7): Xaa at position 7 is Asn, Ala or Val
  misc_feature (8)..(8): Xaa at position 8 is Asn, Ala, Cys, Asp, Glu, Gly, His, Ile, Lys, Leu, Met, Gln, Arg, Ser, Thr or Val
  misc_feature (9)..(9): Xaa at position 9 is Ser, Ala, Cys, Gly or Thr
  misc_feature (10)..(10): Xaa at position 10 is Ser, Ala, Glu, Phe, Gly, His, Ile, Lys, Leu, Asn, Pro, Gln, Arg, Thr or Trp
  misc_feature (11)..(11): Xaa at position 11 is Asn, Ala, Cys, Asp, Glu, Gly, His, Ile, Lys, Leu, Met, Gln, Ser, Thr, Val or Tyr
  misc_feature (12)..(12): Xaa at position 12 is Pro, Ala, Cys, Asp, Glu, Gly, His, Lys, Leu, Asn, Gln, Arg, Ser, Thr, Val, Trp or Tyr
  misc_feature (13)..(13): Xaa at position 13 is Ile, Asn, Gln or Val
  misc_feature (14)..(14): Xaa at position 14 is Glu, Ala, Cys, Phe, His, Lys or G
  misc_feature (15)..(15): Xaa at position 15 is Val, Ala, Cys, Ile, Met or Arg
  misc_feature (17)..(17): Xaa at position 17 is Ile, Glu or Val
  misc_feature (18)..(18): Xaa at position 18 is Asn or Ser
  misc_feature (19)..(19)
  misc_feature (20)..(20): Xaa at position 20 is Trp, Ala or Thr
  misc_feature (22)..(22): Xaa at position 22 is Ser, Ala, Asp, Phe, Gly, His, Ile, Lys, Leu, Met, Asn, Pro, Gln, Arg, Thr, Val or Tyr
  misc_feature (23)..(23): Xaa at position 23 is Asp, Ala, Gly, His, Lys, Met, Asn, Gln, Ser, Thr or Val
  misc_feature (24)..(24): Xaa at position 24 is Gly, Asp or Phe
  misc_feature (25)..(25): Xaa at position 25 is Asp, Ala, Glu, Phe, Asn or Gln
  misc_feature (26)..(26): Xaa at position 26 is Thr, Glu or Pro
  misc_feature (27)..(27): Xaa at position 27 is Ser, Ala, Cys, Asp, Glu, Phe, Gly, His, Asn, Gln, Arg or Thr
  misc_feature (28)..(28): Xaa at position 28 is Phe, Pro, Trp or Tyr
  misc_feature (29)..(29): Xaa at position 29 is Phe, Ala, Cys, Ile, Leu, Gln, Arg, Trp or Tyr
  misc_feature (30)..(30): Xaa at position 30 is Ser, Ala, Cys, Asp, Glu, Phe, Gly, His, Lys, Leu, Met, Asn, Pro, Gln, Arg, Thr, Val, Trp or Tyr
  misc_feature (31)..(31): Xaa at position 31 is Val, Ile or Leu
  misc_feature (32)..(32): Xaa at position 32 is Gly, Ala, Asp, Glu, Phe, His, Lys, Leu, Met, Asn, Pro, Gln, Arg, Ser, Thr, Val, Trp or Tyr
  misc_feature (33)..(33): Xaa at position 33 is Asn, Ala, Cys, Asp, Glu, Phe, Gly, His, Ile, Lys, Leu, Pro, Gln, Arg, Ser, Thr, Val or Tyr
  misc_feature (34)..(34): Xaa at position 34 is Gly, Glu, Phe, His, Lys, Leu, Met, Asn, Gln, Arg, Ser, Thr or Tyr
  misc_feature (35)..(35): Xaa at position 35 is Lys, Ala, Cys, Asp, Gly, His, Ile, Leu, Met, Asn, Gln, Arg, Ser, Thr or Val
  misc_feature (36)..(36): Xaa at position 36 is Gln, Ala, Cys, Glu, Gly, His, Ile, Lys, Leu, Asn, Pro, Arg, Ser, Thr or Val
  misc_feature (37)..(37): Xaa at position 37 is Glu, Ala, Cys, Asp, Phe, Gly, Ile, Lys, Leu, Met, Asn, Ser, Thr or Val
  misc_feature (38)..(38): Xaa at position 38 is Thr, Ala, Cys, Asp, Glu, Phe, Gly, His, Ile, Leu, Met, Asn, Gln, Arg, Ser, Val, Trp or Tyr
  misc_feature (39)..(39): Xaa at position 39 is Trp or Phe
  misc_feature (40)..(40): Xaa at position 40 is Asp, Ala, Cys, Glu, Phe, Gly, His, Ile, Lys, Leu, Met, Asn, Gln, Arg, Ser, Thr, Val, Trp or Tyr
  misc_feature (42)..(42): Xaa at position 42 is Ser, Ala, Cys, Asp, Glu, Phe, Gly, Ile, Lys, Leu, Met, Asn, Gln, Arg, Thr, Val, Trp or Tyr
  misc_feature (44)..(44): Xaa at position 44 is Ser, Ala, Asp, Glu, Gly, Leu, Met, Asn, Pro, Gln, Thr, Val or Tyr
  misc_feature (45)..(45): Xaa at position 45 is Arg, Lys or Ser
  misc_feature (46)..(46): Xaa at position 46 is Gly, Ala or Gln
  misc_feature (47)..(47): Xaa at position 47 is Phe, Cys, Val or Tyr
  misc_feature (48)..(48): Xaa at position 48 is Val, Ile or Leu
  misc_feature (49)..(49): Xaa at position 49 is Leu, Cys, Phe, Met, Arg or Tyr
  misc_feature (50)..(50): Xaa at position 50 is Ser, Ala, Cys, Asp, Ile, Met, Pro, Gln, Thr or Val
  misc_feature (51)..(51): Xaa at position 51 is Leu, Ala, Cys, Met or Val
  misc_feature (52)..(52): Xaa at position 52 is Lys, Cys, Phe, His, Ile, Leu, Met, Asn, Arg, Ser, Thr, Trp or Tyr
  misc_feature (53)..(53): Xaa at position 53 is Lys, Ala, Cys, Asp, Glu, Phe, His, Ile, Leu, Met, Asn, Gln, Arg, Ser, Thr, Val or Tyr
  misc_feature (54)..(54): Xaa at position 54 is Asn, Cys, Asp, Glu, Phe, Gly, Lys, Met, Gln, Arg, Ser or Trp
  misc_feature (56)..(56): Xaa at position 56 is Ala, Gly, Leu, Asn, Pro, Gln, Arg, Ser or Thr
  misc_feature (57)..(57): Xaa at position 57 is Gln, Glu, Leu, Met, Ser or Thr
  misc_feature (58)..(58): Xaa at position 58 is His, Ala, Asp, Phe, Leu, Met, Asn, Arg, Trp or Tyr
  misc_feature (60)..(60): Xaa at position 60 is Tyr, Glu or Phe
  misc_feature (63)..(63): Xaa at position 63 is Gln, Cys, Gly, Ile, Leu, Met, Asn, Thr, Val or Tyr
  misc_feature (64)..(64): Xaa at position 64 is Ala, Phe, Gly, His, Arg, Ser or Tyr
  misc_feature (65)..(65): Xaa at position 65 is Ser, Ala, Cys, Asp, Glu, Phe, Gly, His, Ile, Leu, Asn, Thr or Val
  misc_feature (66)..(66): Xaa at position 66 is Ser, Ala or Gly
  misc_feature (67)..(67): Xaa at position 67 is Lys, Ala, Cys, Asp, Phe, His, Ile, Leu, Met, Asn, Gln, Arg, Ser, Thr, Val, Trp or Tyr
  misc_feature (68)..(68): Xaa at position 68 is Ile Asp, Leu or Val
  misc_feature (69)..(69): Xaa at position 69 is Glu, Ala, Cys, Asp, Phe, His, Ile, Leu, Met, Gln, Arg, Ser, Thr, Val or Tyr
  misc_feature (70)..(70): Xaa at position 70 is Val, Cys or Ile
  misc_feature (71)..(71): Xaa at position 71 is Asp, Ala, Cys, Gly, His, Ile, Leu, Met, Asn, Ser, Thr, Val or Tyr
  misc_feature (72)..(72): Xaa at position 72 is Asn, Ala, Cys, Asp, Glu, Gly, Lys, Met, Pro, Gln, Arg, Ser, Thr, Val or Trp
  misc_feature (73)..(73): Xaa at position 73 is Asn, Ala, Cys, Asp, Phe, Gly, His, Ile, Leu, Ser, Thr, Val or Tyr
  misc_feature (74)..(74): Xaa at position 74 is Ala, Cys, Asp, Phe, Gly, His, Ile, Leu, Asn, Gln, Arg, Ser, Thr, Val or Tyr
  misc_feature (75)..(75): Xaa at position 75 is Val, Cys, Ile or Leu
  misc_feature (76)..(76): Xaa at position 76 is Lys, Ala, Cys, Phe, His, Ile, Leu, Gln, Arg, Ser, Thr, Val, Trp or Tyr
  misc_feature (77)..(77): Xaa at position 77 is Asp Tyr
  misc_feature (78)..(78): Xaa at position 78 is Gln, Ala, Cys, Asp, Phe, Gly, His, Ile, Leu, Met, Asn, Arg, Ser, Thr, Val or Tyr
  misc_feature (79)..(79): Xaa at position 79 is Gly, Arg, Ala, Cys, Asp, Glu, Phe, His, Lys, Leu, Asn, Gln, Arg, Ser, Thr, Trp or Tyr
  misc_feature (80)..(80): Xaa at position 80 is Arg, Ala, Cys, Asp, Phe, Gly, His, Ile, Leu, Asn, Ser, Thr, Val or Tyr
  misc_feature (81)..(81): Xaa at position 81 is Leu, Ala, Cys, Asp, Phe, Gly, His, Ile, Asn, Pro, Arg, Ser, Thr or Val
  misc_feature (82)..(82): Xaa at position 82 is Ile, Ala, Leu, Met, Arg and Val
  misc_feature (82)..(82): Xaa at position 82 is Ile, Ala, Leu, Met, Arg or Val
  misc_feature (83)..(83): Xaa at position 83 is Glu, Ala, Cys, Asp, Phe, Gly, His, Ile, Lys, Leu, Asn, Pro, Arg, Ser, Thr, Val or Tyr
  misc_feature (84)..(84): Xaa at position 84 is Pro, Ala, Cys, Glu, Ile, Ser, Val, Trp or Tyr
  misc_feature (85)..(85): Xaa at position 85 is Leu, Cys, Gly or Val
  misc_feature (86)..(86): Xaa at position 86 is Ser, Ala, Ile, Thr or Val
MXXXXXXXXXXXXXXAXXXXGXXXXXXXXXXXXXXXXXXXRXDXXXXXXXXXXXGXXXPXYVXXXXXXXXXXXXXXXXXXXXXXXX

SEQ ID NO: 847 - protein, 86 aa, Artificial Sequence
  pip
  misc_feature (2)..(2): Xaa at position 2 is Gly, Lys or Ala
  misc_feature (3)..(3): Xaa at position 3 is Ile or Leu
  misc_feature (4)..(4): Xaa at position 4 is Thr or Ser
  misc_feature (5)..(5): Xaa at position 5 is Val or Ile
  misc_feature (6)..(6): Xaa at position 6 is Thr or Lys
  misc_feature (8)..(8): Xaa at position 8 is Asn, Lys, Gly or Ser
  misc_feature (9)..(9): Xaa at position 9 is Ser or Ala
  misc_feature (11)..(11): Xaa at position 11 is Asn, Lys, His or Thr
  misc_feature (12)..(12): Xaa at position 12 is Pro, Thr, Lys or Ser
  misc_feature (13)..(13): Xaa at position 13 is Ile or Val
  misc_feature (14)..(14): Xaa at position 14 is Glu or Asp
  misc_feature (15)..(15): Xaa at position 15 is Val, Ala or Ile
  misc_feature (16)..(16): Xaa at position 16 is Ala or Ser
  misc_feature (17)..(17): Xaa at position 17 is Ile or Val
  misc_feature (18)..(18): Xaa at position 18 is Asn or Ser
  misc_feature (19)..(19): Xaa at position 19 is His, Lys, Arg, Gln or Ala
  misc_feature (21)..(21): Xaa at position 21 is Gly or Arg
  misc_feature (22)..(22): Xaa at position 22 is Ser, Lys, Asn, Asp or Thr
  misc_feature (25)..(25): Xaa at position 25 is Asp or Asn
  misc_feature (26)..(26): Xaa at position 26 is Thr or Asp
  misc_feature (27)..(27): Xaa at position 27 is Ser, Thr, Asn or Lys
  misc_feature (28)..(28): Xaa at position 28 is Phe, Tyr or Pro
  misc_feature (29)..(29): Xaa at position 29 is Phe or Tyr
  misc_feature (30)..(30): Xaa at position 30 is Ser, Gly or Lys
  misc_feature (31)..(31): Xaa at position 31 is Val, Ile or Met
  misc_feature (32)..(32): Xaa at position 32 is Gly, Ala or Asp
  misc_feature (33)..(33): Xaa at position 33 is Asn, Ser, Gln or Pro
  misc_feature (35)..(35): Xaa at position 35 is Lys, Glu or Ser
  misc_feature (36)..(36): Xaa at position 36 is Gln, Asn or Ser
  misc_feature (37)..(37): Xaa at position 37 is Glu or Asp
  misc_feature (38)..(38): Xaa at position 38 is Thr or Ser
  misc_feature (42)..(42): Xaa at position 42 is Ser or Asn
  misc_feature (44)..(44): Xaa at position 44 is Ser, Asp, Ala or Leu
  misc_feature (47)..(47): Xaa at position 47 is Phe or Tyr
  misc_feature (48)..(48): Xaa at position 48 is Leu or Met
  misc_feature (49)..(49): Xaa at position 49 is Leu or Met
  misc_feature (50)..(50): Xaa at position 50 is Ser, Ala or Tyr
  misc_feature (51)..(51): Xaa at position 51 is Leu or Val
  misc_feature (52)..(52): Xaa at position 52 is Lys or Gln
  misc_feature (53)..(53): Xaa at position 53 is Lys, Arg, Met or Leu
  misc_feature (54)..(54): Xaa at position 54 is Asn, Lys or Gly
  misc_feature (55)..(55): Xaa at position 55 is Gly or Ser
  misc_feature (56)..(56): Xaa at position 56 is Ala, Thr, Gln or Ser
  misc_feature (57)..(57): Xaa at position 57 is Gln, Val or Ala
  misc_feature (58)..(58): Xaa at position 58 is His, Ala, Lys, Tyr or Thr
  misc_feature (59)..(59): Xaa at position 59 is Pro or Thr
  misc_feature (62)..(62): Xaa at position 62 is Val or Ile
  misc_feature (63)..(63): Xaa at position 63 is Gln, Ser or Leu
  misc_feature (64)..(64): Xaa at position 64 is Ala, Gln or Ser
  misc_feature (65)..(65): Xaa at position 65 is Ser or Thr
  misc_feature (67)..(67): Xaa at position 67 is Lys, Gln, Arg or Asn
  misc_feature (69)..(69): Xaa at position 69 is Glu, Lys or Val
  misc_feature (70)..(70): Xaa at position 70 is Val or Ile
  misc_feature (71)..(71): Xaa at position 71 is Asp, Glu or Tyr
  misc_feature (72)..(72): Xaa at position 72 is Asn, His, Ser or Asp
  misc_feature (73)..(73): Xaa at position 73 is Asn, Ser or Asp
  misc_feature (74)..(74): Xaa at position 74 is Ala, Thr, Met, Ile or Lys
  misc_feature (76)..(76): Xaa at position 76 is Lys or Thr
  misc_feature (78)..(78): Xaa at position 78 is Gln, His or Ser
  misc_feature (80)..(80): Xaa at position 80 is Arg, Glu or Gln
  misc_feature (81)..(81): Xaa at position 81 is Leu, Pro, Ala or Thr
  misc_feature (82)..(82): Xaa at position 82 is Ile or Leu
  misc_feature (83)..(83): Xaa at position 83 is Glu, His, Asn, Gln or Leu
  misc_feature (85)..(85): Xaa at position 85 is Leu, Val or Ala
  misc_feature (86)..(86): Xaa at position 86 is Ser, Ala, Tyr or Asn
MXXXXXNXXSXXXXXXXXXWXXDGXXXXXXXXXGXXXXWDRXDXRGXXXXXXXXXXXXXYYXXXXSXIXXXXXXVXDXGXXXXPXX

SEQ ID NO: 848 - protein, 86 aa, Artificial Sequence; identical to SEQ ID NO: 847
  pip
  misc_feature (2)..(2): Xaa at position 2 is Gly, Lys, Ala or Arg
  misc_feature (3)..(3): Xaa at position 3 is Ile, Leu or Val
  misc_feature (4)..(4): Xaa at position 4 is Thr or Ser
  misc_feature (5)..(5): Xaa at position 5 is Val, Ile or Leu
  misc_feature (6)..(6): Xaa at position 6 is Thr, Lys, Ser or Arg
  misc_feature (8)..(8): Xaa at position 8 is Asn, Lys, Gly, Ser, Gln, Arg, Thr or Ala
  misc_feature (9)..(9): Xaa at position 9 is Ser, Ala or Thr
  misc_feature (11)..(11): Xaa at position 11 is Asn, Lys, Thr, Gln, Arg, His or Ser
  misc_feature (12)..(12): Xaa at position 12 is Pro, Thr, Lys, Ser or Arg
  misc_feature (13)..(13): Xaa at position 13 is Ile, Val or Leu
  misc_feature (14)..(14): Xaa at position 14 is Glu or Asp
  misc_feature (15)..(15): Xaa at position 15 is Val, Ala, Ile or Leu
  misc_feature (16)..(16): Xaa at position 16 is Ala or Ser
  misc_feature (17)..(17): Xaa at position 17 is Ile, Val or Leu
  misc_feature (18)..(18): Xaa at position 18 is Asn, Ser, Gln or Thr
  misc_feature (19)..(19): Xaa at position 19 is His, Lys, Ala, Gln, Asn or Arg
  misc_feature (21)..(21): Xaa at position 21 is Gly, Arg or Lys
  misc_feature (22)..(22): Xaa at position 22 is Ser, Lys, Asn, Thr, Arg, Asp, Glu or Gln
  misc_feature (25)..(25): Xaa at position 25 is Asp, Asn, Glu or Gln
  misc_feature (26)..(26): Xaa at position 26 is Thr, Asp, Ser or Glu
  misc_feature (27)..(27): Xaa at position 27 is Ser, Thr, Lys, Asn, Gln or Arg
  misc_feature (28)..(28): Xaa at position 28 is Phe, Tyr, Pro or Trp
  misc_feature (29)..(29): Xaa at position 29 is Phe, Tyr or Trp
  misc_feature (30)..(30): Xaa at position 30 is Ser, Gly, Lys, Thr or Arg
  misc_feature (31)..(31): Xaa at position 31 is Val, Ile, Met or Leu
  misc_feature (32)..(32): Xaa at position 32 is Gly, Ala, Asp or Glu
  misc_feature (33)..(33): Xaa at position 33 is Asn, Ser, Gln, Pro or Thr
  misc_feature (35)..(35): Xaa at position 35 is Lys, Glu, Ser, Arg or Thr
  misc_feature (36)..(36): Xaa at position 36 is Gln, Ser, Asn or Thr
  misc_feature (37)..(37): Xaa at position 37 is Glu or Asp
  misc_feature (38)..(38): Xaa at position 38 is Thr or Ser
  misc_feature (42)..(42): Xaa at position 42 is Ser, Asn, Thr or Gln
  misc_feature (44)..(44): Xaa at position 44 is Ser, Asp, Ala, Leu, Thr, Glu, Ile or Val
  misc_feature (47)..(47): Xaa at position 47 is Phe, Tyr or Trp
  misc_feature (48)..(48): Xaa at position 48 is Leu, Met, Ile or Val
  misc_feature (49)..(49): Xaa at position 49 is Leu, Met, Ile or Val
  misc_feature (50)..(50): Xaa at position 50 is Ser, Ala, Tyr or Thr
  misc_feature (51)..(51): Xaa at position 51 is Leu, Val or Ile
  misc_feature (52)..(52): Xaa at position 52 is Lys, Gln, Arg or Asn
  misc_feature (53)..(53): Xaa at position 53 is Lys, Arg, Met, Leu, Ile or Val
  misc_feature (54)..(54): Xaa at position 54 is Asn, Lys, Gly, Gln or Arg
  misc_feature (55)..(55): Xaa at position 55 is Gly, Ser or Thr
  misc_feature (56)..(56): Xaa at position 56 is Ala, Thr, Gln, Ser or Asn
  misc_feature (57)..(57): Xaa at position 57 is Gln, Val, Ala, Asn, Leu or Ile
  misc_feature (58)..(58): Xaa at position 58 is His, Ala, Lys, Tyr or Thr
  misc_feature (59)..(59): Xaa at position 59 is Pro, Thr or Ser
  misc_feature (62)..(62): Xaa at position 62 is Val, Ile or Leu
  misc_feature (63)..(63): Xaa at position 63 is Gln, Ser, Leu, Asn, Thr, Ile or Val
  misc_feature (64)..(64): Xaa at position 64 is Ala, Gln, Ser, Asn or Thr
  misc_feature (65)..(65): Xaa at position 65 is Ser or Thr
  misc_feature (67)..(67): Xaa at position 67 is Lys, Gln, Asn or Arg
  misc_feature (69)..(69): Xaa at position 69 is Glu, Val, Asp, Lys, Arg, Ile or Leu
  misc_feature (70)..(70): Xaa at position 70 is Val, Ile or Leu
  misc_feature (71)..(71): Xaa at position 71 is Asp, Glu, Tyr or Trp
  misc_feature (72)..(72): Xaa at position 72 is Asn, His, Ser, Asp, Gln, Thr or Glu
  misc_feature (73)..(73): Xaa at position 73 is Asn, Ser, Asp, Gln, Thr or Glu
  misc_feature (74)..(74): Xaa at position 74 is Ala, Thr, Met, Ile, Lys, Ser, Leu, Val or Arg
  misc_feature (76)..(76): Xaa at position 76 is Lys, Thr, Arg or Ser
  misc_feature (78)..(78): Xaa at position 78 is Gln, His, Ser, Asn or Thr
  misc_feature (80)..(80): Xaa at position 80 is Arg, Glu, Gln, Lys, Asp or Asn
  misc_feature (81)..(81): Xaa at position 81 is Leu, Pro, Thr, Ile, Val, Ala or Ser
  misc_feature (82)..(82): Xaa at position 82 is Ile, Leu or Val
  misc_feature (83)..(83): Xaa at position 83 is Glu, His, Asn, Leu, Gln, Ile or Val
  misc_feature (85)..(85): Xaa at position 85 is Leu, Val or Ala
  misc_feature (86)..(86): Xaa at position 86 is Ser, Ala, Tyr, Asn or Thr

SEQ ID NO: 849 - protein, 86 aa, Artificial Sequence
  PIP-72 polypeptide
  misc_feature (2)..(2): Xaa at position 2 is Gly, Ala, Cys, Asp, Glu, Ile, Lys, Leu, Asn, Arg, Ser, Thr, Val, Trp or Tyr
  misc_feature (3)..(3): Xaa at position 3 is Ile, Leu, Val or Trp
  misc_feature (4)..(4): Xaa at position 4 is Thr, Ala, Asp, Glu, His, Ile, Lys, Leu, Arg, Ser, Val, Trp or Tyr
  misc_feature (5)..(5): Xaa at position 5 is Val, Ala, Cys, Gly, His, Ile, Leu or Tyr
  misc_feature (6)..(6): Xaa at position 6 is Thr, Ala, Cys, Phe, Gly, His, Ile, Lys, Met, Pro, Gln, Arg, Ser, Trp or Tyr
  misc_feature (7)..(7): Xaa at position 7 is Asn, Ala or Val
  misc_feature (8)..(8): Xaa at position 8 is Asn, Lys, Gly, Ser, Gln, Arg, Thr, Ala, Cys, Asp, Glu, His, Ile, Leu, Met or Val
  misc_feature (9)..(9): Xaa at position 9 is Ser, Ala, Cys, Gly or Thr
  misc_feature (11)..(11): Xaa at position 11 is Asn, Lys, Thr, Gln, Arg, Ser, Ala, Cys, Asp, Glu, Gly, His, Ile, Leu, Met, Val or Tyr
  misc_feature (12)..(12): Xaa at position 12 is Pro, Thr, Lys, Ser, Arg, Ala, Cys, Asp, Glu, Gly, His, Leu, Asn, Gln, Arg, Val, Trp or Tyr
  misc_feature (13)..(13): Xaa at position 13 is Ile, Asn, Gln, Leu or Val
  misc_feature (14)..(14): Xaa at position 14 is Glu, Ala, Cys, Phe, His, Lys or Gln
  misc_feature (15)..(15): Xaa at position 15 is Val, Ala, Ile, Leu, Cys, Met or Arg
  misc_feature (16)..(16): Xaa at position 16 is Ala or Ser
  misc_feature (17)..(17): Xaa at position 17 is Ile, Glu, Leu or Val
  misc_feature (18)..(18): Xaa at position 18 is Asn, Gln, Thr or Ser
  misc_feature (19)..(19): Xaa at position 19 is His, Lys, Ala, Arg, Glu, Leu, Pro, Ser or Tyr
  misc_feature (20)..(20): Xaa at position 20 is Trp, Ala or Thr
  misc_feature (21)..(21): Xaa at position 21 is Gly, Arg or Lys
  misc_feature (22)..(22): Xaa at position 22 is Ser, Ala, Asp, Phe, Gly, His, Ile, Lys, Leu, Met, Asn, Pro, Gln, Arg, Thr, Val or Tyr
  misc_feature (23)..(23): Xaa at position 23 is Asp, Ala, Gly, His, Lys, Met, Asn, Gln, Ser, Thr or Val
  misc_feature (24)..(24): Xaa at position 24 is Gly, Asp or Phe
  misc_feature (25)..(25): Xaa at position 25 is Asp, Ala, Glu, Phe, Asn or Gln
  misc_feature (26)..(26): Xaa at position 26 is Thr, Glu, Asp, Ser or Pro
  misc_feature (27)..(27): Xaa at position 27 is Ser, Thr, Lys, Arg, Ala, Cys, Asp, Glu, Phe, Gly, His, Asn or Gln
  misc_feature (28)..(28): Xaa at position 28 is Phe, Tyr, Pro or Trp
  misc_feature (29)..(29): Xaa at position 29 is Phe, Ala, Cys, Ile, Leu, Gln, Arg, Trp or Tyr
  misc_feature (30)..(30): Xaa at position 30 is Ser, Gly, Lys, Thr, Arg, Ala, Cys, Asp, Glu, Phe, His, Leu, Met, Asn, Pro, Gln, Val, Trp or Tyr
  misc_feature (31)..(31): Xaa at position 31 is Val, Ile, Met or Leu
  misc_feature (32)..(32): Xaa at position 32 is Gly, Ala, Asp, Glu, Phe, His, Lys, Leu, Met, Asn, Pro, Gln, Arg, Ser, Thr, Val, Trp or Tyr
  misc_feature (33)..(33): Xaa at position 33 is Asn, Ser, Gln, Pro, Thr, Ala, Cys, Asp, Glu, Phe, Gly, His, Ile, Lys, Leu, Arg, Val or Tyr
  misc_feature (34)..(34): Xaa at position 34 is Gly, Glu, Phe, His, Lys, Leu, Met, Asn, Gln, Arg, Ser, Thr or Tyr
  misc_feature (35)..(35): Xaa at position 35 is Lys, Glu, Ala, Cys, Asp, Gly, His, Ile, Leu, Met, Asn, Gln, Arg, Ser, Thr or Val
  misc_feature (36)..(36): Xaa at position 36 is Gln, Ala, Cys, Glu, Gly, His, Ile, Lys, Leu, Asn, Pro, Arg, Ser, Thr or Val
  misc_feature (37)..(37): Xaa at position 37 is Glu, Asp, Ala, Cys, Phe, Gly, Ile, Lys, Leu, Met, Asn, Ser, Thr or Val
  misc_feature (38)..(38): Xaa at position 38 is Thr, Ser, Ala, Cys, Asp, Glu, Phe, Gly, His, Ile, Leu, Met, Asn, Gln, Arg, Val, Trp or Tyr
  misc_feature (39)..(39): Xaa at position 39 is Trp or Phe
  misc_feature (40)..(40): Xaa at position 40 is Asp, Ala, Cys, Glu, Phe, Gly, His, Ile, Lys, Leu, Met, Asn, Gln, Arg, Ser, Thr, Val, Trp or Tyr
  misc_feature (42)..(42): Xaa at position 42 is Ser, Asn, Thr, Ala, Cys, Asp, Glu, Phe, Gly, Ile, Lys, Leu, Met, Arg, Val, Trp, Tyr or Gln
  misc_feature (44)..(44): Xaa at position 44 is Ser, Asp, Ala, Leu, Thr, Glu, Ile, Ala, Gly, Leu, Met, Asn, Pro, Gln, Val, Tyr or Val
  misc_feature (45)..(45): Xaa at position 45 is Arg, Lys or Ser
  misc_feature (46)..(46): Xaa at position 46 is Gly, Ala or Gln
  misc_feature (47)..(47): Xaa at position 47 is Phe, Tyr Cys, Val or Trp
  misc_feature (48)..(48): Xaa at position 48 is Leu, Met, Ile, Cys, Phe, Met, Arg, Tyr or Val
  misc_feature (49)..(49): Xaa at position 49 is Leu, Met, Ile or Val
  misc_feature (50)..(50): Xaa at position 50 is Ser, Ala, Tyr, Cys, Asp, Ile, Met, Pro, Gln, Val or Thr
  misc_feature (51)..(51): Xaa at position 51 is Leu, Val, Ala, Cys, Met or Ile
  misc_feature (52)..(52): Xaa at position 52 is Lys, Cys, Phe, His, Ile, Leu, Met, Asn, Arg, Ser, Thr, Trp or Tyr
  misc_feature (53)..(53): Xaa at position 53 is Lys, Arg, Met, Leu, Ile, Ala, Cys, Asp, Glu, Phe, His, Asn, Gln, Ser, Thr, Tyr or Val
  misc_feature (54)..(54): Xaa at position 54 is Asn, Cys, Asp, Glu, Phe, Gly, Lys, Met, Gln, Arg, Ser or Trp
  misc_feature (55)..(55): Xaa at position 55 is Gly, Ser or Thr
  misc_feature (56)..(56): Xaa at position 56 is Ala, Thr, Gln, Ser, Gly, Leu, Pro, Arg or Asn
  misc_feature (57)..(57): Xaa at position 57 is Gln, Glu, Leu, Met, Val, Ala, Asn,  Ile, Ser or Thr
  misc_feature (58)..(58): Xaa at position 58 is His, Ala, Lys, Asp, Phe, Leu, Met, Asn, Arg, Trp, Tyr or Thr
  misc_feature (59)..(59): Xaa at position 59 is Pro, Thr or Ser
  misc_feature (60)..(60): Xaa at position 60 is Tyr, Glu or Phe
  misc_feature (62)..(62): Xaa at position 62 is Val, Ile or Leu
  misc_feature (63)..(63): Xaa at position 63 is Gln, Ser, Leu, Asn, Thr, Ile or Val
  misc_feature (64)..(64): Xaa at position 64 is Ala, Gln, Asn, Phe, Gly, His, Arg, Ser or Tyr
  misc_feature (65)..(65): Xaa at position 65 is Ser, Ala, Cys, Asp, Glu, Phe, Gly, His, Ile, Leu, Asn, Val or Thr
  misc_feature (66)..(66): Xaa at position 66 is Ser, Ala or Gly
  misc_feature (67)..(67): Xaa at position 67 is Lys, Gln, Asn or Arg
  misc_feature (68)..(68): Xaa at position 68 is Ile Asp, Leu or Val
  misc_feature (69)..(69): Xaa at position 69 is Glu, Ala, Cys, Asp, Phe, His, Ile, Leu, Met, Gln, Arg, Ser, Thr, Val or Tyr
  misc_feature (70)..(70): Xaa at position 70 is Val, Ile, Cys or Leu
  misc_feature (71)..(71): Xaa at position 71 is Asp, Glu, Tyr, Ala, Cys, Gly, His, Ile, Leu, Met, Asn, Ser, Thr, Val or Trp
  misc_feature (72)..(72): Xaa at position 72 is Asn, Ala, Cys, Asp, Glu, Gly, Lys, Met, Pro, Gln, Arg, Ser, Thr, Val, His or Trp
  misc_feature (73)..(73): Xaa at position 73 is Asn, Ser, Asp, Gln, Thr, Ala, Cys, Phe, Gly, His, Ile, Leu, Val, Tyr or Glu
  misc_feature (74)..(74): Xaa at position 74 is Ala, Thr, Met, Ile, Lys, Ser, Leu, Val, Cys, Asp, Phe, Gly, His, Asn, Gln, Tyr or Arg
  misc_feature (75)..(75): Xaa at position 75 is Val, Cys, Ile or Leu
  misc_feature (76)..(76): Xaa at position 76 is Lys, Ala, Cys, Phe, His, Ile, Leu, Gln, Arg, Ser, Thr, Val, Trp or Tyr
  misc_feature (77)..(77): Xaa at position 77 is Asp Tyr
  misc_feature (78)..(78): Xaa at position 78 is Gln, His, Ser, Asn, Ala, Cys, Asp, Phe, Gly, Ile, Leu, Met, Asn, Arg, Val, Tyr or Thr
  misc_feature (79)..(79): Xaa at position 79 is Gly, Arg, Ala, Cys, Asp, Glu, Phe, His, Lys, Leu, Asn, Gln, Arg, Ser, Thr, Trp or Tyr
  misc_feature (80)..(80): Xaa at position 80 is Arg, Glu, Gln, Lys, Asp, Ala, Cys, Phe, Gly, His, Ile, Leu, Ser, Thr, Val, Tyr or Asn
  misc_feature (81)..(81): Xaa at position 81 is Leu, Pro, Thr, Ile, Val, Ala, Cys, Asp, Phe, Gly, His or Ser
  misc_feature (82)..(82): Xaa at position 82 is Ile, Ala, Leu, Met, Arg and Val
  misc_feature (83)..(83): Xaa at position 83 is Glu, His, Asn, Leu, Gln, Ile, Ala, Cys, Asp, Phe, Gly, Lys, Pro, Arg, Ser, Thr, Tyr or Val
  misc_feature (84)..(84): Xaa at position 84 is Pro, Ala, Cys, Glu, Ile, Ser, Val, Trp or Tyr
  misc_feature (85)..(85): Xaa at position 85 is Leu, Val, Cys, Gly or Ala
  misc_feature (86)..(86): Xaa at position 86 is Ser, Ala, Tyr, Asn, Ile, Val or Thr
MXXXXXXXXSXXXXXXXXXXXXXXXXXXXXXXXXXXXXXXRXDXXXXXXXXXXXXXXXXXYXXXXXXXXXXXXXXXXXXXXXXXXX

SEQ ID NO: 850 - DNA, 261 bp, Artificial Sequence
  Coding sequence for PIP-72 polypeptide
atggcgatcaccgtgacgaacaactcctccaacccgatcgaggtggcgatcaaccactggggcagcgacggcgacaccagcttcttctccgtcggcaacggcaagcaggagacctgggacaggtccgacagccgcggcttcgtgctctccctgaagaagaacggcgctcagcacccgtactacgtccaggccagcagcaagatcgaggtcgacaacaacgccgtgaaggaccagggtcggctgatcgagccgctctcgtga

SEQ ID NO: 851 - DNA, 261 bp, Artificial Sequence
  Coding sequence for PIP-72 polypeptide
atggcgatcacggtgacgaacaactcgagcaaccctatcgaggtcgcgatcaaccactggggctctgacggggacacgagcttcttcagcgtcgggaacgggaagcaggagacgtgggaccgcagcgactcgcgcggcttcgtcctgtcgctcaagaagaacggtgcccagcacccgtactacgtgcaggcgtcgtcgaagatcgaggtcgacaacaacgcggtcaaggaccagggcaggctcatcgagccgctgtcctga

SEQ ID NO: 852 - protein, 86 aa, Artificial Sequence
  PIP-72 polypeptide
MAITVTNNSSNPIEVAINHWGSDGDTSFFSVGNGKQETWDRSDSRGFVLSLKKNGAQHPYYVQASSKIEVDNNAVKDQGRLIEPLS

SEQ ID NO: 853 - DNA, 258 bp, Artificial Sequence
  PIP-72Aa coding sequence with maize optimized codons
atgggtatcacggtcaccaacaacagcagcaaccctatcgaagtggcgatcaaccactggggcagcgacggcgacaccagcttcttcagcgtcggcaacggcaagcaggaaacgtgggacaggtccgactcacgcggcttcgtgctgtccctgaagaagaacggcgcgcagcatccgtactacgtgcaggcgtcgtcgaagatcgaggtggacaacaacgcggtcaaggaccagggtaggctgattgagccgctgtct

SEQ ID NO: 854 - DNA, 258 bp, Artificial Sequence
  PIP-72Aa coding sequence with maize optimized codons
atggggatcacagtcaccaacaacagcagcaacccaatcgaggtcgcgatcaaccactggggaagcgacggagacacctcgttcttcagcgtcggcaacggcaagcaggagacttgggacaggtcagactccagaggcttcgtactgtccctgaagaagaacggcgctcagcatccgtactacgtgcaagcctcgtcgaagatcgaggtggacaacaacgcggtcaaggatcagggtaggctgatcgagccactgtct

SEQ ID NO: 855 - DNA, 258 bp, Artificial Sequence
  PIP-72Aa coding sequence with maize optimized codons
atgggaatcactgtcaccaacaactcgtccaaccctatcgaggtcgcgatcaaccactggggttccgatggggacacgtccttcttcagcgtcggcaatggcaagcaggagacgtgggacaggtccgactccagaggcttcgtgctctcgctgaagaagaacggcgctcagcacccttactacgtgcaggcctcgtcgaagatcgaggtggacaacaacgcggttaaggatcagggtaggctgattgagcctctgtct

SEQ ID NO: 856 - DNA, 258 bp, Artificial Sequence
  PIP-72Aa coding sequence with maize optimized codons
atgggaatcacagtcaccaacaacagcagcaacccgatcgaggtcgcgatcaaccactggggtagcgacggcgacaccagcttcttctccgtgggcaacggcaaacaggagacgtgggacaggtcagacagccgcggcttcgtgctgtccctcaagaagaacggcgcccagcacccatactacgtgcaagcctcgtcgaagatcgaggtggacaacaacgcggtgaaggaccagggtagactgattgagccgctgagc

SEQ ID NO: 857 - DNA, 258 bp, Artificial Sequence
  PIP-72Aa coding sequence with maize optimized codons
atgggtatcacagtcaccaacaactcctcaaacccgatcgaggtggcgatcaaccactggggcagcgacggcgatacctcattcttcagcgttgggaacggcaagcaggagacgtgggatcggtctgacagcagagggtttgttctgtcgctgaagaagaacggcgctcagcacccatactacgtccaagcctcctcgaagatcgaggttgacaacaacgccgttaaggatcagggcagactgattgagccactgtcc

SEQ ID NO: 858 - DNA, 258 bp, Artificial Sequence
  PIP-72Aa coding sequence with maize optimized codons
atgggaataacagtcaccaacaacagcagcaacccgatcgaagtggcgatcaaccactggggtagcgacggcgacacctccttcttcagcgtcggcaacggcaagcaggagacgtgggacaggtccgactctcgcggattcgtcctgtcgctcaagaagaacggtgcccagcacccctactacgtgcaggcctcgtcgaagatcgaggtggacaacaacgcggtcaaggaccaagggaggctgatcgagccgctgtcg

SEQ ID NO: 859 - DNA, 258 bp, Artificial Sequence
  PIP-72Aa coding sequence with maize optimized codons
atggggatcacggtgacgaacaactcctccaatccgatcgaggtggcgatcaaccactggggatcagacggtgacacgagcttcttcagcgttggcaacgggaagcaggagacgtgggacaggtctgacagcagaggttttgtgctgtcgctcaagaagaacggcgctcaacacccatactacgtccaagcctcctctaagatcgaggtggacaacaacgctgtgaaggatcagggcagactcatcgagccactgtcg

SEQ ID NO: 860 - DNA, 258 bp, Artificial Sequence
  PIP-72Aa coding sequence with maize optimized codons
atgggaatcaccgtcaccaacaacagcagcaaccctatcgaagtcgctatcaaccactggggaagcgacggcgacacctccttcttcagcgtcggcaatggcaagcaggagacgtgggacaggtccgactccagaggattcgtgctgtccctgaagaagaacggcgctcagcacccatactacgtgcaagcttcgtcgaagatcgaggtggacaacaacgcggtcaaggatcaagggaggctgatcgagccgctgtcc

SEQ ID NO: 861 - DNA, 258 bp, Artificial Sequence
  PIP-72Aa coding sequence with maize optimized codons
atgggtatcacggtgaccaacaactcctccaacccgatcgaggtggcgatcaaccactggggctcggacggcgacacgagcttcttcagcgtcggcaacgggaagcaggagacgtgggaccgctctgacagcagaggtttcgtgctgtcgctcaagaagaacggcgctcaacacccgtactacgtccaagcctcctccaagatcgaggtcgacaacaacgccgtgaaggaccaaggcagactcatcgagccgctgtcg

SEQ ID NO: 862 - DNA, 258 bp, Artificial Sequence
  PIP-72Aa coding sequence with maize optimized codons
atgggtataaccgtgacgaacaactcctcaaatccgatcgaggtcgcgatcaaccactgggggtcagacggtgacacgagcttcttctccgtgggcaacggtaagcaggagacctgggataggtcggactcaaggggctttgtgctgagcctcaagaagaacggtgctcagcacccgtactacgtccaagcgagctccaagatcgaggtggacaacaacgctgtcaaggaccaaggtaggctgatcgaaccgctgagc

SEQ ID NO: 863 - DNA, 258 bp, Artificial Sequence
  PIP-72Aa coding sequence with maize optimized codons
atggggatcacagtcaccaacaacagcagcaacccgatcgaagtcgcgatcaaccactggggaagcgacggcgacacctcgttcttcagcgtcggcaacggcaagcaggagacgtgggataggtccgactcacgcggcttcgtgctgtccctgaagaagaacggcgcccagcatccgtactacgtgcaagcctcgtcgaagatcgaggtggacaacaacgcggtgaaggaccagggtagactgatcgagccactgtcc

SEQ ID NO: 864 - DNA, 258 bp, Artificial Sequence
  PIP-72Aa coding sequence with maize optimized codons
atgggtatcacggtgacgaacaactcctccaatcctatcgaggtcgcgatcaaccactgggggtcagacggtgacacgagcttcttctccgtgggcaacggcaagcaggagacctgggacaggtcggactcaaggggcttcgtcctgagcctcaagaagaacggcgctcagcacccgtactacgtccaagcgagctccaagatcgaggtggacaacaacgccgtcaaggaccagggtaggctgatcgaaccgctgagc

SEQ ID NO: 865 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
tatcgaaggtaggcatatgnnkattaccgttacaaacaattc

SEQ ID NO: 866 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
cgaaggtaggcatatgggtnnkaccgttacaaacaattcgtc

SEQ ID NO: 867 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
gaaggtaggcatatgggtattnnkgttacaaacaattcgtcc

SEQ ID NO: 868 - DNA, 41 bp, Artificial Sequence
  mutagenesis primer
  misc_feature (21)..(21): n = g, a, t or c
  misc_feature (22)..(22): n = g, a, t or c
  misc_feature (23)..(23): k = g or t
gtaggcatatgggtattaccnnkacaaacaattcgtccaac

SEQ ID NO: 869 - DNA, 44 bp, Artificial Sequence
  mutagenesis primer
  misc_feature (21)..(21): n = g, a, t or c
  misc_feature (22)..(22): n = g, a, t or c
  misc_feature (23)..(23): k = g or t
ggcatatgggtattaccgttnnkaacaattcgtccaaccccatc

SEQ ID NO: 870 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
caaacaattcgtccaaccccnnkgaagtcgccatcaatcattg

SEQ ID NO: 871 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
aacaattcgtccaaccccatcnnkgtcgccatcaatcattgg

SEQ ID NO: 872 - DNA, 41 bp, Artificial Sequence
  PIP-72 variant polypeptide
  misc_feature (21)..(21): n = g, a, t or c
  misc_feature (22)..(22): n = g, a, t or c
  misc_feature (23)..(23): k = g or t
ccaaccccatcgaagtcgccnnkaatcattggggtagcgac

SEQ ID NO: 873 - DNA, 41 bp, Artificial Sequence
  mutagenesis primer
  misc_feature (18)..(18): n = g, a, t or c
  misc_feature (19)..(19): n = g, a, t or c
  misc_feature (20)..(20): k = g or t
ccatcgaagtcgccatcnnkcattggggtagcgacggagac

SEQ ID NO: 874 - DNA, 42 bp, Artificial Sequence
  mutagenesis primer
  misc_feature (19)..(19): n = g, a, t or c
  misc_feature (20)..(20): n = g, a, t or c
  misc_feature (21)..(21): k = g or t
gtcgccatcaatcattggnnkagcgacggagacaccagcttc

SEQ ID NO: 875 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
gtcgccatcaatcattggggtnnkgacggagacaccagcttc

SEQ ID NO: 876 - DNA, 45 bp, Artificial Sequence
  mutagenesis primer
  misc_feature (23)..(23): n = g, a, t or c
  misc_feature (24)..(24): n = g, a, t or c
  misc_feature (25)..(25): k = g or t
caatcattggggtagcgacggannkaccagcttcttttccgtcgg

SEQ ID NO: 877 - DNA, 45 bp, Artificial Sequence
  mutagenesis primer
  misc_feature (22)..(22): n = g, a, t or c
  misc_feature (23)..(23): n = g, a, t or c
  misc_feature (24)..(24): k = g or t
cattggggtagcgacggagacnnkagcttcttttccgtcggtaac

SEQ ID NO: 878 - DNA, 44 bp, Artificial Sequence
  mutagenesis primer
  misc_feature (21)..(21): n = g, a, t or c
  misc_feature (22)..(22): n = g, a, t or c
  misc_feature (23)..(23): k = g or t
tttccgtcggtaacggcaagnnkgaaacctgggacaggtccgac

SEQ ID NO: 879 - DNA, 43 bp, Artificial Sequence
  mutagenesis primer
  misc_feature (20)..(20): n = g, a, t or c
  misc_feature (21)..(21): n = g, a, t or c
  misc_feature (22)..(22): k = g or t
cgtgctttccctgaagaagnnkggcgcgcaacacccttactac

SEQ ID NO: 880 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k g or t
tgctttccctgaagaagaatnnkgcgcaacacccttactacgt

SEQ ID NO: 881 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
cctgaagaagaatggcgcgnnkcacccttactacgttcaggc

SEQ ID NO: 882 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
gaagaatggcgcgcaacacnnktactacgttcaggccagcag

SEQ ID NO: 883 - DNA, 41 bp, Artificial Sequence
  mutagenesis primer
  misc_feature (20)..(20): n = g, a, t or c
  misc_feature (21)..(21): n = g, a, t or c
  misc_feature (22)..(22): k = g or t
cgcgcaacacccttactacnnkcaggccagcagcaaaattg

SEQ ID NO: 884 - DNA, 42 bp, Artificial Sequence
  mutagenesis primer
  misc_feature (21)..(21): n = g, a, t or c
  misc_feature (22)..(22): n = g, a, t or c
  misc_feature (23)..(23): k = g or t
cgcaacacccttactacgttnnkgccagcagcaaaattgaag

SEQ ID NO: 885 - DNA, 43 bp, Artificial Sequence
  mutagenesis primer
  misc_feature (22)..(22): n = g, a, t or c
  misc_feature (23)..(23): n = g, a, t or c
  misc_feature (24)..(24): k = g or t
caacacccttactacgttcagnnkagcagcaaaattgaagtcg

SEQ ID NO: 886 - DNA, 42 bp, Artificial Sequence
  mutagenesis primer
  misc_feature (22)..(22): n = g, a, t or c
  misc_feature (23)..(23): n = g, a, t or c
  misc_feature (24)..(24): k = g or t
gttcaggccagcagcaaaattnnkgtcgacaacaacgccgtg

SEQ ID NO: 887 - DNA, 42 bp, Artificial Sequence
  mutagenesis primer
  misc_feature (21)..(21): n = g, a, t or c
  misc_feature (22)..(22): n = g, a, t or c
  misc_feature (23)..(23): k = g or t
gcagcaaaattgaagtcgacnnkaacgccgtgaaagatcagg

SEQ ID NO: 888 - DNA, 42 bp, Artificial Sequence
  mutagenesis primer
  misc_feature (20)..(20): n = g, a, t or c
  misc_feature (21)..(21): n = g, a, t or c
  misc_feature (22)..(22): k = g or t
gaaagatcagggccggttgnnkgagccgctctcgtaaggatc

SEQ ID NO: 889 - DNA, 43 bp, Artificial Sequence
  mutagenesis primer
  misc_feature (21)..(21): n = g, a, t or c
  misc_feature (22)..(2): n = g, a, t or c
  misc_feature (22)..(22): n is a, c, g, or t
  misc_feature (23)..(23): k = g or t
gtattaccgttacaaacaatnnktccaaccccatcgaagtcgc

SEQ ID NO: 890 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
gcgacttcgatggggttggamnnattgtttgtaacggtaatac

SEQ ID NO: 891 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
gtagcgacggagacaccagcnnkttttccgtcggtaacggcaa

SEQ ID NO: 892 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
ttgccgttaccgacggaaaamnngctggtgtctccgtcgctac

SEQ ID NO: 893 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = a or c
gcgacggagacaccagcttcnnktccgtcggtaacggcaagca

SEQ ID NO: 894 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
tgcttgccgttaccgacggamnngaagctggtgtctccgtcgc

SEQ ID NO: 895 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or c
tcttttccgtcggtaacggcnnkcaggaaacctgggacaggtc

SEQ ID NO: 896 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
gacctgtcccaggtttcctgmnngccgttaccgacggaaaaga

SEQ ID NO: 897 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
gtggcttcgtgctttccctgnnkaagaatggcgcgcaacaccc

SEQ ID NO: 898 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
gggtgttgcgcgccattcttmnncagggaaagcacgaagccac

SEQ ID NO: 899 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): m = a or c
actacgttcaggccagcagcnnkattgaagtcgacaacaacgc

SEQ ID NO: 900 - DNA, 43 bp, Artificial Sequence
  mutagenesis primer
  misc_feature (2)..(23): n = g, a, t or c
  misc_feature (21)..(21): m = a or c
  misc_feature (22)..(22): n = g, a, t or c
gcgttgttgtcgacttcaatmnngctgctggcctgaacgtagt

SEQ ID NO: 901 - DNA, 43 bp, Artificial Sequence
  mutagenesis primer
  misc_feature (21)..(21): n = g, a, t or c
  misc_feature (22)..(22): n = g, a, t or c
  misc_feature (23)..(23): k = g or t
aagtcgacaacaacgccgtgnnkgatcagggccggttgatcga

SEQ ID NO: 902 - DNA, 43 bp, Artificial Sequence
  mutagenesis primer
  misc_feature (21)..(21): m = a or c
  misc_feature (22)..(22): n = g, a, t or c
  misc_feature (23)..(23): n = g, a, t or c
tcgatcaaccggccctgatcmnncacggcgttgttgtcgactt

SEQ ID NO: 903 - protein, 86 aa, Artificial Sequence
  PIP-72 variant polypeptide
MGITVTNNSENPIEVAINHWGSDGDTSFFSVGNGKQETWDRSDSRGFVMSLKKNGAQHPYYVQASSKIEVDNNAVKDQGRLIYPLS

SEQ ID NO: 904 - protein, 86 aa, Artificial Sequence; identical to SEQ ID NO: 649
  PIP-72 variant polypeptide

SEQ ID NO: 905 - protein, 86 aa, Artificial Sequence
  PIP-72 variant polypeptide
MGITVTNNSENPIEVAINHWGSDGDTSFFGIDSGKQESWDRSDSRGFVLSLKRNGAQAPYYVQASSKIEVDNNAVKDQGRLIEPLS

SEQ ID NO: 906 - protein, 86 aa, Artificial Sequence
  PIP-72 variant polypeptide
MGITVTNNSTNPIEVAINHWGSDGDTSFFGIDSGKQESWDRSDSRGFVLSLKRNGAQAPYYVQASSKIEVDNNAVKDQGRLIEPLS

SEQ ID NO: 907 - protein, 86 aa, Artificial Sequence
  PIP-72 variant polypeptide
MGITVTNNSVNPIEVAINHWGSDGDTSFFGIDSGKQESWDRSDSRGFVLSLKRNGAQAPYYVQASSKIEVDNNAVKDQGRLIEPLS

SEQ ID NO: 908 - protein, 86 aa, Artificial Sequence
  PIP-72 variant polypeptide
MGITVTNNSANPIEVAINHWGSDGDTSFFGIDSGKQESWDRSDSRGFVLSLKRNGAQAPYYVQASSKIEVDNNAVKDQGRLIEPLS

SEQ ID NO: 909 - protein, 86 aa, Artificial Sequence
  PIP-72 variant polypeptide
MGITVTNNSLNPIEVAINHWGSDGDTSFFGIDSGKQESWDRSDSRGFVLSLKRNGAQAPYYVQASSKIEVDNNAVKDQGRLIEPLS

SEQ ID NO: 910 - protein, 86 aa, Artificial Sequence
  PIP-72 variant polypeptide
MGITVTNNSENPIEVAINHWGSDGDTSFFGIDSGKQESWDRSDSRGFVLSLKRNGAQAPYYVQASSKIEVDNNAVKDHGRLIEPLS

SEQ ID NO: 911 - protein, 86 aa, Artificial Sequence
  PIP-72 variant polypeptide
MGITVTNMSSNPIEVAINHWGSDGDTSFFGIDSGKQESWDRSDSRGFVLSLKRNGAQAPYYVQASSKIEVDNNAVKDQGRLIEPLS

SEQ ID NO: 912 - protein, 86 aa, Artificial Sequence
  PIP-72 variant polypeptide
MGITVTNNSSNPIEVAINHWGSDGDTSFFGIDSGKQESWDRSDSRGFVLSLKRNGAQAPYYVQASSKIEVHNNAVKDQGRLIFPLS

SEQ ID NO: 913 - protein, 86 aa, Artificial Sequence
  PIP-72 variant polypeptide
MGISVTNNSSNPIEVAINHWGSDGDTSFFGIDSGKQESWDRSDSRGFVLSLKRQGAQAPYYVQASSKIEVDNNAVKDHGRLIEPLS

SEQ ID NO: 914 - protein, 86 aa, Artificial Sequence
  PIP-72 variant polypeptide
MGITVTNNSSNPIEVAINHWGSDGDTSFFGIDSGKQESWDRSDSRGFVLSLKRNGAQAPYYVQASSKIEVHNNAVKDQGRLIEPLS

SEQ ID NO: 915 - DNA, 258 bp, Artificial Sequence
  PIP-72 variant polypeptide
atgggtattaccgttacaaacaattcggaaaaccccatcgaagtcgccatcaatcattggggtagcgacggagacaccagcttcttttccgtcggtaacggcaagcaggaaacctgggacaggtccgacagccgtggcttcgtgatgtccctgaagaagaatggcgcgcaacacccttactacgttcaggccagcagcaaaattgaagtcgacaacaacgccgtgaaagatcagggccggttgatctatccgctctcg

SEQ ID NO: 916 - DNA, 258 bp, Artificial Sequence
  PIP-72 variant polypeptide
atgggtattaccgttacaaacaattcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 917 - DNA, 258 bp, Artificial Sequence
  PIP-72 variant polypeptide
atgggtattaccgttacaaacaattcggaaaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 918 - DNA, 258 bp, Artificial Sequence
  PIP-72 variant polypeptide
atgggtattaccgttacaaacaattcgacgaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 919 - DNA, 258 bp, Artificial Sequence
  PIP-72 variant polypeptide
atgggtattaccgttacaaacaattcggttaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 920 - DNA, 258 bp, Artificial Sequence
  PIP-72 variant polypeptide
atgggtattaccgttacaaacaattcggctaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 921 - DNA, 258 bp, Artificial Sequence
  PIP-72 variant polypeptide
atgggtattaccgttacaaacaattcgttgaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 922 - DNA, 258 bp, Artificial Sequence
  PIP-72 variant polypeptide
atgggtattaccgttacaaacaattcggaaaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcatggccggttgatcgagccgctctcg

SEQ ID NO: 923 - DNA, 258 bp, Artificial Sequence
  PIP-72 variant polypeptide
atgggtattaccgttacaaacatgtcgtccaaccccatcgaagtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtcgacaacaacgccgtgaaagatcagggccggttgatcgagccgctctcg

SEQ ID NO: 924 - DNA, 258 bp, Artificial Sequence
  PIP-72 variant polypeptide
atgggtattaccgttacaaacaattcgtccaaccccatcgaggtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtccataacaacgccgtgaaagatcagggccggttgatcttcccgctctcg

SEQ ID NO: 925 - DNA, 258 bp, Artificial Sequence
  PIP-72 variant polypeptide
atgggcattagcgttacaaacaattcgtccaaccccatcgaagtcgccatcaatcattggggtagcgacggagacaccagcttctttggcattgacagcggcaagcaggagtcttgggacaggtccgacagccgtggcttcgtgctttccctgaagcgtcaaggcgcccaagctccttactacgttcaggccagcagcaaaattgaagtcgacaacaacgccgtgaaagatcatggccggttgatcgagccgctctcc

SEQ ID NO: 926 - DNA, 258 bp, Artificial Sequence
  PIP-72 variant polypeptide
atgggtattaccgttacaaacaattcgtccaaccccatcgaggtcgccatcaatcattggggtagcgacggagacaccagcttctttggcattgacagcggcaagcaggaatcttgggacaggtccgacagccgtggcttcgtgctttccctgaagcgtaatggcgcgcaagctccttactacgttcaggccagcagcaaaattgaagtccacaacaacgccgtgaaagatcagggccggttgatcgagccgctctcg

SEQ ID NO: 927 - protein, 86 aa, Pseudomonas chlororaphis
MGITVKNNSSNPIEVAINRWGNDGDTNFFSVGNGKQETWDRSDSRGFVLSLKKNGAQHPYYVQASSKIEVDNNAVKDQGQLIEPLS

SEQ ID NO: 928 - protein, 86 aa, Pseudomonas brassicacearum
MGITVKNNSSNTIEVAVNHWGSDGDTSFFSIANGKQESWDRSDSRGFVLSLKKNGAQHPYYVQASSRIEVDNNAVKDQGQPIQPLS

SEQ ID NO: 929 - protein, 86 aa, Pseudomonas sp. QTF5
MGITVTNNSSHTIEVAINQWGDDGDTSFFSIANGKNESWDRSDDRGFVLSLQKNGAQYPYYVQASSNIKVDNNGVTDQGEAIYPLA

SEQ ID NO: 930 - protein, 86 aa, Halomonas anticariensis
MTIQVTNNAQQEVEVAINEWGTGGDTSFFTLHQGKSEKWDRVDERGFVMAVKHRGAQRPYYVQHQSNINIYDHRVTDHDSIIRTID

SEQ ID NO: 931 - protein, 90 aa, Burkholderia pseudomallei
MAISVKNSASNTVEVSINHWGTDGDTKPFKMAPGASDSWNRTDLRGFVMYVQLGGSATPYYVLSTSNIVIYDDKVTDSGQTLLPANKRFG

SEQ ID NO: 932 - protein, 91 aa, Pseudomonas entomophila
MKLTITNGASTSIDIAVSAWRNDGNDSYYSIAQGESDTWDRSDARGYLMAVKMKSQVKTYYISQASKIVVEDNLVKDHGQTINPLYAVNSM

SEQ ID NO: 933 - protein, 91 aa, Pseudomonas entomophila
MKLTITNGASTSIEIAVSAWRNDGNDSYYSIAQGESDTWDRSDARGYLMAVKMKSQVKTYYISQTSKIVVEDNIVKDHGQTLNPLYAANNM

SEQ ID NO: 934 - protein, 96 aa, Pseudomonas chlororaphis
MSITVTNGASTVVNVAISTWEKDGSDAYWPLEQGKGDTWKRSDPRGYLMAIQDKSQTTEYYVTCNSVIVIEDNLVKDHGRTLNPVAAAGKKNVVNA

SEQ ID NO: 935 - protein, 96 aa, Pseudomonas chlororaphis
MSITVTNGASAVVKVAISTWQKDGNDDFWSLDQGASDTWKRSDTRGYLMAVQDKSRTTEYYVSCNSAIVIEDNLVKDHGRTLNPLIAAGQKNVANA

SEQ ID NO: 936 - protein, 89 aa, Burkholderia multivorans
MAITVTNKSAEDVQVSISTWGNHGDPNPYPVKTGVTESWDRKDPRGFVLYLQKGATAQPYYVQAGAAIVFFSFQEVTDNGEPIHPVSAP

SEQ ID NO: 937 - protein, 90 aa, Burkholderia pseudomallei
MAISVKNSASNTVEVSINHWGTDGDTKPFKMAPGASDSWNRNDLRGFVMYVQLGGSATPYYVLSTSNIVIYDDKVTDSGQTLLPANKRFG

SEQ ID NO: 938 - protein, 92 aa, Burkholderia pseudomallei
MAISVKNSASNTVEVSINNWETDVDTSTKPFKMAPGASDSWNRTDLRGYVIYVQLGGSATPYYVMSTSNIVIYDDKVTDSGQTLLPANKRFG

SEQ ID NO: 939 - protein, 95 aa, Pseudomonas chlororaphis
MSIKITNGATREVQVAVSFWYTDGKAGDVSDTYYPLKPGSGEEWKRNDPRGYLMTIKGQSQAGVYYVAFDSEILIEDNLVKDRGETITRLSLKFE

SEQ ID NO: 940 - protein, 96 aa, Pseudomonas chlororaphis
MSITVTNGASAVVNVAISTWEKDGSDAYYPLEQGSGDTWKRSDPRGYLMAIQDKSQTTEYYVSCNSAIVIEDNLVKDDGRTLNPVAAAGKKKVVNA

SEQ ID NO: 941 - protein, 91 aa, Pseudomonas mosselii
MKLTITNGASTSVDIAVSTWRNDGNDSYYSIAQGESDTWDRSDARGYLMAVKMKSQVKTYYISQTSKIVVEDNLVKDHGQTLNPLYAVNNM

SEQ ID NO: 942 - protein, 76 aa, Burkholderia thailandensis
MSINHWGTDGDTKPFKMAPGASDSWNCTDFRGYVMYVQLGGSATPYYVLSTSNIVIYDDKVTDSGQTLLPANKRFG

SEQ ID NO: 943 - protein, 91 aa, Pseudomonas protegens
MGTISVSNGASGEINVSVSTWQKDGVDTYFTIAPGNFETWTRNDPRGYLMAVNGNTKKNEYYISPTSKIVIEDNLVKDHGQTIYPLILANA

SEQ ID NO: 944 - protein, 91 aa, Pseudomonas plecoglossicida
MKLTITNGASTSIEIAVSAWRNDGNDSYYSIAQGESDTWDRSDARGYLMAVKMKSQVKTYYISQTSKIVVEDNIVKDHGQTLNPLYAVNNM

SEQ ID NO: 945 - protein, 90 aa, Unknown
  unknown
MSITITNGASRTVQIAVSVWGRDGSDDYYALEPGKGDTWGRNDPRGYLMAIKGQTQAGVYYVAFDSQIVIEDNLVKDRGRTINPLASNNQ

SEQ ID NO: 946 - protein, 98 aa, Pseudomonas chlororaphis
MKMSITVTNGASTVVNVAISTWEKDGSDAYYPLQQGSGDTWKRSDPRGYLMAIQDKSQTTEYYVSCNSVIVIEDNVVKDHGRTLNPVAAAGKKKVANA

SEQ ID NO: 947 - protein, 85 aa, Paludibacterium yongneupense
MIKVINKTGLPIKVSINHWGSGGDTSYFTIEKDKAETWDRTDARGFVMATIVKGVGRSQIVFAGTEVVVDEKYLSGSVKTEAVEA

SEQ ID NO: 948 - protein, 76 aa, Burkholderia thailandensis
MSINHWGTDGDTNPFKMAPGASDSWNRTDLRGYVMYVQLGGSATPYYVLSTSNIVIYDDKVTDSGQTLLPANQRFG

SEQ ID NO: 949 - DNA, 258 bp, Pseudomonas chlororaphis
atgggtattaccgttaaaaacaattcgtccaaccccatcgaagttgccatcaatcgttggggtaacgacggagacaccaacttcttttccgtcggtaacggcaaacaggaaacctgggacaggtccgacagccgtggcttcgtgctttccctgaagaagaatggcgcgcaacacccgtactacgttcaggccagcagcaaaattgaagtcgacaacaacgccgtgaaagatcagggccagttgatcgagccgctctcg

SEQ ID NO: 950 - DNA, 258 bp, Pseudomonas brassicacearum
atgggcattactgttaaaaataactcatccaacaccattgaagttgcggtcaatcattggggcagcgacggagataccagcttcttttcaatcgctaacggcaagcaggaaagctgggacaggtccgacagccgcggttttgtactctccttgaagaaaaatggagcacaacatccgtactacgttcaggccagtagcagaattgaagtcgacaataatgcagtgaaggatcagggccagcctattcaacccctctcc

SEQ ID NO: 951 - DNA, 258 bp, Pseudomonas sp. QTF5
atgggcattaccgttacaaataactcatcacacactattgaagttgcaatcaatcagtggggagatgacggggatacgagttttttttcaatagctaacggcaaaaacgaaagctgggatcggtctgacgatcgcggctttgttctctctttacaaaaaaatggagcacaatatccgtattacgttcaggccagtagcaatattaaagttgacaataacggagtaacggatcagggcgaggctatttatcctctagcc

SEQ ID NO: 952 - DNA, 258 bp, Halomonas anticariensis
atgactatccaagtcacaaataacgcccaacaagaggttgaagttgccatcaatgagtggggtaccggcggcgataccagctttttcacattacatcaaggcaagtccgagaaatgggatcgcgtcgatgaacgcggctttgtgatggcagtgaaacataggggggcgcaacgcccatattacgtccagcatcaaagcaacattaacatctatgaccatagagttaccgatcacgactcgattattcgtacgatagac

SEQ ID NO: 953 - DNA, 270 bp, Burkholderia pseudomallei
atggcgataagcgtcaaaaacagcgcatcgaacacggttgaagtgtcgatcaatcactggggaacggacggagacaccaagccgttcaagatggcgcccggagccagcgattcctggaatcgcaccgacctacgtggcttcgtcatgtatgtgcagctgggcgggtcggcgacgccgtactatgtgctgagcaccagcaatatcgtgatctacgacgacaaggtgacggatagcgggcaaacgctccttcccgcaaacaagcgttttggc

SEQ ID NO: 954 - DNA, 273 bp, Pseudomonas entomophila
atgaagctcacgatcaccaatggcgcaagcacatcgattgatattgcagtgagtgcatggcgtaacgacggcaatgacagttactactcgatagctcaaggagagtctgatacctgggaccgcagcgacgccagagggtacttgatggcggtaaaaatgaaatcccaagtaaaaacctactatatttctcaagccagcaagatcgttgttgaagacaaccttgtgaaagaccacggtcaaactattaatccgctgtacgcagtaaatagcatg

SEQ ID NO: 955 - DNA, 273 bp, Pseudomonas entomophila
atgaagctcacgatcaccaatggcgcaagcacatcgattgaaattgcagtgagtgcatggcgtaacgacggcaatgacagttactactcgatagctcaaggggaatctgatacctgggaccgcagcgacgcaagagggtacttgatggcggtaaaaatgaaatcccaggtaaaaacctactacatatcccaaaccagcaagatagttgttgaagacaacattgttaaagaccacggccaaacccttaacccgctatacgcagcaaacaacatg

SEQ ID NO: 956 - DNA, 291 bp, Pseudomonas chlororaphis
atgagcatcacagtcaccaacggggcaagcacagtagttaacgtggcaatcagtacatgggagaaagacggcagtgacgcttactggccattagagcaaggcaaaggtgatacctggaaacgtagtgacccaaggggttacttgatggccatacaggataaatcccaaacaactgaatactacgtcacctgcaacagtgtaattgtcatcgaagacaacctcgtgaaggatcacggccggactcttaacccagtcgccgcggccgggaagaaaaatgtggtaaatgcgtaa

SEQ ID NO: 957 - DNA, 288 bp, Pseudomonas chlororaphis
atgagcatcacagtcacaaacggtgcaagcgcagtagttaaagtagccattagcacatggcagaaagacggcaatgacgatttctggtcattagatcaaggcgcaagcgatacctggaaacgtagcgacacaaggggctacttgatggccgtgcaagacaagtcccgcacaactgaatactacgtttcctgcaacagcgccatcgttatcgaagacaacctcgtcaaagatcacggtcgaactcttaacccactcattgcggccgggcagaagaacgtggcgaatgcg

SEQ ID NO: 958 - DNA, 267 bp, Burkholderia multivorans
atggcaattactgtgacgaacaaatcggcagaagatgtccaggtgtccatcagcacctggggcaatcacggcgacccgaatccgtacccggtcaagaccggggtcacggaaagctgggaccgcaaggacccgcgcggcttcgtgctgtacctgcagaaaggggcgacggcgcagccgtactacgtacaggccggcgcagcaatcgtgttcttctccttccaggaggtcacggacaacggcgagccgatccacccggtgagtgcgccg

SEQ ID NO: 959 - DNA, 270 bp, Burkholderia pseudomallei
atggcgataagcgtcaaaaacagcgcatcgaacacggttgaagtgtcgatcaatcactggggaacggacggagacaccaagccgttcaagatggcgcccggagccagcgattcctggaatcgcaacgacctacgtggcttcgtcatgtatgtgcagttgggcgggtcggcgacgccgtactatgtgctgagcaccagtaatatcgtgatctacgacgacaaggtgacggatagcgggcaaacgctccttcccgcaaacaagcgttttggc

SEQ ID NO: 960 - DNA, 276 bp, Burkholderia pseudomallei
atggcgataagcgtcaaaaacagcgcatcgaacacggttgaagtgtcgatcaataactgggaaacggacgtagacaccagcaccaagccgttcaagatggcgcccggagccagcgattcctggaatcgcaccgacctacgtggctacgtcatctatgtgcagctgggcgggtcggcgacgccgtactatgtgatgagcaccagcaatatcgtgatctacgacgacaaggtgacggatagcgggcaaacgctccttcccgcaaacaagcgttttggc

SEQ ID NO: 961 - DNA, 285 bp, Pseudomonas chlororaphis
atgagcatcaaaatcacaaacggggccaccagagaggtccaagtcgcagtcagcttttggtatacagatggtaaagccggtgacgtcagtgatacctattacccactgaagcccggcagtggtgaagaatggaaacgcaatgacccaagaggttacttgatgaccataaaaggccaatcccaagcaggtgtatattacgttgcctttgacagcgaaatcctcatagaagacaaccttgtaaaggaccgcggcgaaaccattacccgactatctttgaagtttgaa

SEQ ID NO: 962 - DNA, 288 bp, Pseudomonas chlororaphis
atgagcatcacagtcacaaacggagcaagcgcagtagttaacgtggcaatcagcacatgggagaaagacggcagtgacgcttactacccattagagcaaggcagcggtgacacctggaaacgtagtgacccaaggggttacttgatggccatacaggataaatcccaaacaactgaatactacgtctcctgcaacagtgcaattgtcatcgaagacaacctcgtaaaggatgacggccgaactcttaacccagtcgctgcggccgggaagaaaaaagtggtaaatgcg

SEQ ID NO: 963 - DNA, 273 bp, Pseudomonas mosselii
atgaagctcacgatcaccaatggcgcaagcacctcagttgacattgcagtgagtacatggcgtaacgacggcaatgacagctactactcaatagctcaaggggaatctgatacctgggaccgcagcgacgcaagagggtacttgatggcggtaaaaatgaaatcccaggtaaaaacctactacatctcccaaaccagcaagatcgttgttgaagacaaccttgtgaaagaccacggtcaaacgcttaatccgctatatgcagtgaataacatg

SEQ ID NO: 964 - DNA, 228 bp, Burkholderia thailandensis
gtgtcgatcaatcactggggaacggacggcgacaccaagccgttcaagatggcgcccggagccagcgattcctggaattgcaccgactttcgcggctacgtcatgtatgtgcagctgggcgggtcggcgacgccgtactatgtgctgagcaccagcaatatcgtgatctacgacgacaaggtgacggatagcgggcaaacgctccttcccgcaaacaagcgttttggc

SEQ ID NO: 965 - DNA, 273 bp, Pseudomonas protegens
atgggtacaatctcggtctcaaacggtgcaagcggggaaattaatgtttcagttagcacatggcaaaaagacggtgttgacacttatttcacaatagccccgggcaactttgaaacttggacgcgcaacgatccaagaggctatttaatggccgtaaatggcaacaccaagaaaaacgaatactacatctcccccaccagcaaaatagttatcgaggacaaccttgtaaaggaccacggccaaactatttacccattaattctagctaacgcg

SEQ ID NO: 966 - DNA, 276 bp, Pseudomonas plecoglossicida
atgaagctcacgatcaccaatggcgcaagcacctcagttgacattgcagtgagtacatggcgtaacgacggtaatgacagctactactcaatagctcaaggggaatctgatacttgggaccgcagcgacgcaagagggtacttgatggcggtaaaaatgaaatcccaagtaaaaacctactacatctcccaaaccagtaagatcgttgttgaagacaacattgtaaaagaccacggccaaacgcttaatccgctatacgcattaaataacatgtag

SEQ ID NO: 967 - DNA, 270 bp, Unknown
  unknown
atgagcatcacaatcacaaacggagcaagcagaacggtccaaattgcagtcagcgtatgggggcgagacggcagtgacgattattatgcactggagcccggcaaaggtgatacatgggggcgtaatgacccaagaggttacttgatggccataaaaggccagacccaagcaggtgtatattacgttgcctttgacagtcaaatcgtcatagaagacaaccttgtaaaggatcgcggccgaactatcaacccactcgcttcgaacaatcaa

SEQ ID NO: 968 - DNA, 288 bp, Pseudomonas chlororaphis
atgagcatcacagtcacaaacggggcaagcacagtagttaacgtggcaatcagtacatgggagaaagacggcagtgacgcttactacccattacagcaaggcagcggtgacacctggaaacgtagtgacccaaggggttacttgatggccattcaggataaatcccaaacaactgaatactacgtctcctgcaacagtgtaattgtcatcgaagacaacgtcgtgaaggatcacggccggactcttaacccagtcgctgcggccgggaagaaaaaagtggcaaatgcg

SEQ ID NO: 969 - DNA, 255 bp, Paludibacterium yongneupense
atgatcaaagttatcaataaaaccggtcttccgatcaaggtttcgatcaaccactggggaagcggcggcgatacgagctacttcacgatagaaaaagacaaggctgaaacgtgggaccgcactgacgcccgtggcttcgtgatggcaacgatcgtcaagggcgtcggtcgctcacaaatcgtgttcgcaggcacggaggtcgtcgttgatgaaaaatatctctcaggctcggttaaaaccgaggcagtagaagca

SEQ ID NO: 970 - DNA, 228 bp, Burkholderia thailandensis
gtgtcgatcaatcactggggaacggacggagacaccaatccgttcaagatggcgcccggagccagcgattcctggaatcgcaccgaccttcgcggctacgtcatgtatgtgcagttgggcgggtcggcgacgccgtactatgtgctgagtaccagcaatatcgtgatctacgacgacaaggtgacggatagcgggcaaacgctccttcccgcaaaccagcgttttggc

SEQ ID NO: 971 - DNA, 38 bp, Artificial Sequence
  Cloning Primer
atgatcatatgggtattaccgttaaaaacaattcgtcc

SEQ ID NO: 972 - DNA, 38 bp, Artificial Sequence
  Cloning Primer
atggatccttacgagagcggctcgatcaactggccctg

SEQ ID NO: 973 - DNA, 38 bp, Artificial Sequence
  Cloning Primer
atgatcatatgggcattactgttaaaaataactcatcc

SEQ ID NO: 974 - DNA, 35 bp, Artificial Sequence
  Cloning Primer
atggatccttaggagaggggttgaataggctggcc

SEQ ID NO: 975 - DNA, 34 bp, Artificial Sequence
  Cloning Primer
atgatcatatgaagctcacgatcaccaatggcgc

SEQ ID NO: 976 - DNA, 35 bp, Artificial Sequence
  Cloning Primer
atggatccttacatgttgtttgctgcgtatagcgg

SEQ ID NO: 977 - DNA, 37 bp, Artificial Sequence
  Cloning Primer
atgatcatatgagcatcacagtcacaaacggagcaag

SEQ ID NO: 978 - DNA, 36 bp, Artificial Sequence
  Cloning Primer
atggatccttacgcatttaccacttttttcttcccg

SEQ ID NO: 979 - DNA, 37 bp, Artificial Sequence
  Cloning Primer
atgatcatatgagcatcaaaatcacaaacggggccac

SEQ ID NO: 980 - DNA, 39 bp, Artificial Sequence
  Cloning Primer
atggatccttattcaaacttcaaagatagtcgggtaatg

That which is claimed:

1. A DNA construct comprising a nucleic acid molecule, encoding a PIP-72 polypeptide having insecticidal activity against Western corn rootworm (*Diabrotica virgifera virgifera*), operably linked to a heterologous regulatory element, wherein the encoded PIP-72 polypeptide comprises an amino acid sequence having at least 80% sequence identity to SEQ ID NO: 2.

2. The DNA construct of claim 1, wherein the encoded PIP-72 polypeptide comprises 1 to 17 amino acid substitutions at position 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 57, 58, 59, 60, 62, 63, 64, 65, 66, 67, 68, 69, 70, 71, 72, 73, 74, 75, 76, 77, 78, 79, 80, 81, 82, 83, 84, 85 or 86, compared to the corresponding amino acid of SEQ ID NO: 2.

3. The DNA construct of claim 1, wherein the encoded PIP-72 polypeptide comprises 1 to 17 amino acid substitutions at position 2, 3, 4, 5, 6, 7, 8, 9, 10, 11, 12, 13, 14, 15, 17, 18, 19, 20, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 58, 60, 63, 64, 65, 66, 67, 68, 69, 70, 71, 72, 73, 74, 75, 76, 77, 78, 79, 80, 81, 82, 83, 84, 85 or 86 compared to the corresponding amino acid of SEQ ID NO: 2.

4. The DNA construct of claim 1, wherein the encoded PIP-72 polypeptide comprises an amino acid sequence of the formula:

```
                                                      (SEQ ID NO: 846)
Met Xaa Xaa Xaa Xaa Xaa Xaa Xaa Xaa Xaa Xaa Xaa Xaa Xaa Xaa Ala
1               5                   10                  15

Xaa Xaa Xaa Xaa Gly Xaa Xaa Xaa Xaa Xaa Xaa Xaa Xaa Xaa Xaa
            20                  25                  30

Xaa Xaa Xaa Xaa Xaa Xaa Xaa Xaa Arg Xaa Asp Xaa Xaa Xaa Xaa Xaa
        35                  40                  45

Xaa Xaa Xaa Xaa Xaa Xaa Gly Xaa Gln Xaa Pro Xaa Tyr Val Xaa Xaa
    50                  55                  60

Xaa Xaa Xaa Xaa Xaa Xaa Xaa Xaa Xaa Xaa Xaa Xaa Xaa Xaa Xaa
65                  70                  75                  80

Xaa Xaa Xaa Xaa Xaa Xaa
            85
``` wherein

Xaa at position 2 is Gly, Ala, Cys, Asp, Glu, Ile, Lys, Leu, Asn, Arg, Ser, Thr, Val, Trp or Tyr;

Xaa at position 3 is Ile or Trp;

Xaa at position 4 is Thr, Ala, Asp, Glu, His, Ile, Lys, Leu, Arg, Ser, Val, Trp or Tyr;

Xaa at position 5 is Val, Ala, Cys, Gly, His, Ile or Tyr;

Xaa at position 6 is Thr, Ala, Cys, Phe, Gly, His, Ile, Lys, Met, Pro, Gln, Arg, Ser, Trp or Tyr;

Xaa at position 7 is Asn, Ala or Val;

Xaa at position 8 is Asn, Ala, Cys, Asp, Glu, Gly, His, Ile, Lys, Leu, Met, Gln, Arg, Ser, Thr or Val;

Xaa at position 9 is Ser, Ala, Cys, Gly or Thr;

Xaa at position 10 is Ser, Ala, Glu, Phe, Gly, His, Ile, Lys, Leu, Asn, Pro, Gln, Arg, Thr or Trp;

Xaa at position 11 is Asn, Ala, Cys, Asp, Glu, Gly, His, Ile, Lys, Leu, Met, Gln, Ser, Thr, Val or Tyr;

Xaa at position 12 is Pro, Ala, Cys, Asp, Glu, Gly, His, Lys, Leu, Asn, Gln, Arg, Ser, Thr, Val, Trp or Tyr;

Xaa at position 13 is Ile, Asn, Gln or Val;

Xaa at position 14 is Glu, Ala, Cys, Phe, His, Lys or Gln;

Xaa at position 15 is Val, Ala, Cys, Ile, Met or Arg;

Xaa at position 17 is Ile, Glu or Val;

Xaa at position 18 is Asn or Ser;

Xaa at position 19 is His, Ala, Glu, Lys, Leu, Pro, Arg, Ser or Tyr;

Xaa at position 20 is Trp, Ala or Thr;

Xaa at position 22 is Ser, Ala, Asp, Phe, Gly, His, Ile, Lys, Leu, Met, Asn, Pro, Gln, Arg, Thr, Val or Tyr;

Xaa at position 23 is Asp, Ala, Gly, His, Lys, Met, Asn, Gln, Ser, Thr or Val;

Xaa at position 24 is Gly, Asp or Phe;

Xaa at position 25 is Asp, Ala, Glu, Phe, Asn or Gln;

Xaa at position 26 is Thr, Glu or Pro;

Xaa at position 27 is Ser, Ala, Cys, Asp, Glu, Phe, Gly, His, Asn, Gln, Arg or Thr;

Xaa at position 28 is Phe, Pro, Trp or Tyr;

Xaa at position 29 is Phe, Ala, Cys, Ile, Leu, Gln, Arg, Trp or Tyr;

Xaa at position 30 is Ser, Ala, Cys, Asp, Glu, Phe, Gly, His, Lys, Leu, Met, Asn, Pro, Gln, Arg, Thr, Val, Trp or Tyr;

Xaa at position 31 is Val, Ile or Leu;

Xaa at position 32 is Gly, Ala, Asp, Glu, Phe, His, Lys, Leu, Met, Asn, Pro, Gln, Arg, Ser, Thr, Val, Trp or Tyr;
Xaa at position 33 is Asn, Ala, Cys, Asp, Glu, Phe, Gly, His, Ile, Lys, Leu, Pro, Gln, Arg, Ser, Thr, Val or Tyr;
Xaa at position 34 is Gly, Glu, Phe, His, Lys, Leu, Met, Asn, Gln, Arg, Ser, Thr or Tyr;
Xaa at position 35 is Lys, Ala, Cys, Asp, Gly, His, Ile, Leu, Met, Asn, Gln, Arg, Ser, Thr or Val;
Xaa at position 36 is Gln, Ala, Cys, Glu, Gly, His, Ile, Lys, Leu, Asn, Pro, Arg, Ser, Thr or Val;
Xaa at position 37 is Glu, Ala, Cys, Asp, Phe, Gly, Ile, Lys, Leu, Met, Asn, Ser, Thr or Val;
Xaa at position 38 is Thr, Ala, Cys, Asp, Glu, Phe, Gly, His, Ile, Leu, Met, Asn, Gln, Arg, Ser, Val, Trp or Tyr;
Xaa at position 39 is Trp or Phe;
Xaa at position 40 is Asp, Ala, Cys, Glu, Phe, Gly, His, Ile, Lys, Leu, Met, Asn, Gln, Arg, Ser, Thr, Val, Trp or Tyr;
Xaa at position 42 is Ser, Ala, Cys, Asp, Glu, Phe, Gly, Ile, Lys, Leu, Met, Asn, Gln, Arg, Thr, Val, Trp or Tyr;
Xaa at position 44 is Ser, Ala, Asp, Glu, Gly, Leu, Met, Asn, Pro, Gln, Thr, Val or Tyr;
Xaa at position 45 is Arg, Lys or Ser;
Xaa at position 46 is Gly, Ala or Gln;
Xaa at position 47 is Phe, Cys, Val or Tyr;
Xaa at position 48 is Val, Ile or Leu;
Xaa at position 49 is Leu, Cys, Phe, Met, Arg or Tyr;
Xaa at position 50 is Ser, Ala, Cys, Asp, Ile, Met, Pro, Gln, Thr or Val;
Xaa at position 51 is Leu, Ala, Cys, Met or Val;
Xaa at position 52 is Lys, Cys, Phe, His, Ile, Leu, Met, Asn, Arg, Ser, Thr, Trp or Tyr;
Xaa at position 53 is Lys, Ala, Cys, Asp, Glu, Phe, His, Ile, Leu, Met, Asn, Gln, Arg, Ser, Thr, Val or Tyr;
Xaa at position 54 is Asn, Cys, Asp, Glu, Phe, Gly, Lys, Met, Gln, Arg, Ser or Trp;
Xaa at position 56 is Ala, Gly, Leu, Asn, Pro, Gln, Arg, Ser or Thr;
Xaa at position 57 is Gln, Glu, Leu, Met, Ser or Thr;
Xaa at position 58 is His, Ala, Asp, Phe, Leu, Met, Asn, Arg, Trp or Tyr;
Xaa at position 60 is Tyr, Glu or Phe;
Xaa at position 63 is Gln, Cys, Gly, Ile, Leu, Met, Asn, Thr, Val or Tyr;
Xaa at position 64 is Ala, Phe, Gly, His, Arg, Ser or Tyr;
Xaa at position 65 is Ser, Ala, Cys, Asp, Glu, Phe, Gly, His, Ile, Leu, Asn, Thr or Val;
Xaa at position 66 is Ser, Ala or Gly;
Xaa at position 67 is Lys, Ala, Cys, Asp, Phe, His, Ile, Leu, Met, Asn, Gln, Arg, Ser, Thr, Val, Trp or Tyr;
Xaa at position 68 is Ile Asp, Leu or Val;
Xaa at position 69 is Glu, Ala, Cys, Asp, Phe, His, Ile, Leu, Met, Gln, Arg, Ser, Thr, Val or Tyr;
Xaa at position 70 is Val, Cys or Ile;
Xaa at position 71 is Asp, Ala, Cys, Gly, His, Ile, Leu, Met, Asn, Ser, Thr, Val or Tyr;
Xaa at position 72 is Asn, Ala, Cys, Asp, Glu, Gly, Lys, Met, Pro, Gln, Arg, Ser, Thr, Val or Trp;
Xaa at position 73 is Asn, Ala, Cys, Asp, Phe, Gly, His, Ile, Leu, Ser, Thr, Val or Tyr;
Xaa at position 74 is Ala, Cys, Asp, Phe, Gly, His, Ile, Leu, Asn, Gln, Arg, Ser, Thr, Val or Tyr;
Xaa at position 75 is Val, Cys, Ile or Leu;
Xaa at position 76 is Lys, Ala, Cys, Phe, His, Ile, Leu, Gln, Arg, Ser, Thr, Val, Trp or Tyr;
Xaa at position 77 is Asp Tyr;
Xaa at position 78 is Gln, Ala, Cys, Asp, Phe, Gly, His, Ile, Leu, Met, Asn, Arg, Ser, Thr, Val or Tyr;
Xaa at position 79 is Gly, Arg, Ala, Cys, Asp, Glu, Phe, His, Lys, Leu, Asn, Gln, Arg, Ser, Thr, Trp or Tyr;
Xaa at position 80 is Arg, Ala, Cys, Asp, Phe, Gly, His, Ile, Leu, Asn, Ser, Thr, Val or Tyr;
Xaa at position 81 is Leu, Ala, Cys, Asp, Phe, Gly, His, Ile, Asn, Pro, Arg, Ser, Thr or Val;
Xaa at position 82 is Ile, Ala, Leu, Met, Arg or Val;
Xaa at position 83 is Glu, Ala, Cys, Asp, Phe, Gly, His, Ile, Lys, Leu, Asn, Pro, Arg, Ser, Thr, Val or Tyr;
Xaa at position 84 is Pro, Ala, Cys, Glu, Ile, Ser, Val, Trp or Tyr;
Xaa at position 85 is Leu, Cys, Gly or Val; and
Xaa at position 86 is Ser, Ala, Ile, Thr or Val.

5. The DNA construct of claim 1, wherein the encoded PIP-72 polypeptide comprises an amino acid sequence of the formula:

SEQ ID NO: 849

Met Xaa Xaa Xaa Xaa Xaa Xaa Xaa Ser Xaa Xaa Xaa Xaa Xaa Xaa
1               5                   10                  15

Xaa Xaa Xaa Xaa Xaa Xaa Xaa Xaa Xaa Xaa Xaa Xaa Xaa Xaa Xaa
                20                  25                  30

Xaa Xaa Xaa Xaa Xaa Xaa Xaa Arg Xaa Asp Xaa Xaa Xaa Xaa Xaa
            35                  40                  45

Xaa Xaa Xaa Xaa Xaa Xaa Xaa Xaa Xaa Xaa Xaa Tyr Xaa Xaa Xaa
        50                  55                  60

Xaa Xaa Xaa Xaa Xaa Xaa Xaa Xaa Xaa Xaa Xaa Xaa Xaa Xaa Xaa
65                  70                  75                  80

Xaa Xaa Xaa Xaa Xaa Xaa
                85 wherein

Xaa at position 2 is Gly, Ala, Cys, Asp, Glu, Ile, Lys, Leu, Asn, Arg, Ser, Thr, Val, Trp or Tyr;
Xaa at position 3 is Ile, Leu, Val or Trp;
Xaa at position 4 is Thr, Ala, Asp, Glu, His, Ile, Lys, Leu, Arg, Ser, Val, Trp or Tyr;
Xaa at position 5 is Val, Ala, Cys, Gly, His, Ile, Leu or Tyr;
Xaa at position 6 is Thr, Ala, Cys, Phe, Gly, His, Ile, Lys, Met, Pro, Gln, Arg, Ser, Trp or Tyr;
Xaa at position 7 is Asn, Ala or Val;
Xaa at position 8 is Asn, Lys, Gly, Ser, Gln, Arg, Thr, Ala, Cys, Asp, Glu, His, Ile, Leu, Met or Val;
Xaa at position 9 is Ser, Ala, Cys, Gly or Thr;
Xaa at position 11 is Asn, Lys, Thr, Gln, Arg, Ser, Ala, Cys, Asp, Glu, Gly, His, Ile, Leu, Met, Val or Tyr;

Xaa at position 12 is Pro, Thr, Lys, Ser, Arg, Ala, Cys, Asp, Glu, Gly, His, Leu, Asn, Gln, Arg, Val, Trp or Tyr;
Xaa at position 13 is Ile, Asn, Gln, Leu or Val;
Xaa at position 14 is Glu, Ala, Cys, Phe, His, Lys, Asp or Gln;
Xaa at position 15 is Val, Ala, Ile, Leu, Cys, Met or Arg;
Xaa at position 16 is Ala or Ser;
Xaa at position 17 is Ile, Glu, Leu or Val;
Xaa at position 18 is Asn, Gln, Thr or Ser;
Xaa at position 19 is His, Lys, Ala, Arg, Glu, Leu, Pro, Ser or Tyr;
Xaa at position 20 is Trp, Ala or Thr;
Xaa at position 21 is Gly, Arg or Lys;
Xaa at position 22 is Ser, Ala, Asp, Phe, Gly, His, Ile, Lys, Leu, Met, Asn, Pro, Gln, Arg, Thr, Val or Tyr;
Xaa at position 23 is Asp, Ala, Gly, His, Lys, Met, Asn, Gln, Ser, Thr or Val;
Xaa at position 24 is Gly, Asp or Phe;
Xaa at position 25 is Asp, Ala, Glu, Phe, Asn or Gln;
Xaa at position 26 is Thr, Glu, Asp, Ser or Pro;
Xaa at position 27 is Ser, Thr, Lys, Arg, Ala, Cys, Asp, Glu, Phe, Gly, His, Asn or Gln;
Xaa at position 28 is Phe, Tyr, Pro or Trp;
Xaa at position 29 is Phe, Ala, Cys, Ile, Leu, Gln, Arg, Trp or Tyr;
Xaa at position 30 is Ser, Gly, Lys, Thr, Arg, Ala, Cys, Asp, Glu, Phe, His, Leu, Met, Asn, Pro, Gln, Val, Trp or Tyr;
Xaa at position 31 is Val, Ile, Met or Leu;
Xaa at position 32 is Gly, Ala, Asp, Glu, Phe, His, Lys, Leu, Met, Asn, Pro, Gln, Arg, Ser, Thr, Val, Trp or Tyr;
Xaa at position 33 is Asn, Ser, Gln, Pro, Thr, Ala, Cys, Asp, Glu, Phe, Gly, His, Ile, Lys, Leu, Arg, Val or Tyr;
Xaa at position 34 is Gly, Glu, Phe, His, Lys, Leu, Met, Asn, Gln, Arg, Ser, Thr or Tyr;
Xaa at position 35 is Lys, Glu, Ala, Cys, Asp, Gly, His, Ile, Leu, Met, Asn, Gln, Arg, Ser, Thr or Val;
Xaa at position 36 is Gln, Ala, Cys, Glu, Gly, His, Ile, Lys, Leu, Asn, Pro, Arg, Ser, Thr or Val;
Xaa at position 37 is Glu, Asp, Ala, Cys, Phe, Gly, Ile, Lys, Leu, Met, Asn, Ser, Thr or Val;
Xaa at position 38 is Thr, Ser, Ala, Cys, Asp, Glu, Phe, Gly, His, Ile, Leu, Met, Asn, Gln, Arg, Val, Trp or Tyr;
Xaa at position 39 is Trp or Phe;
Xaa at position 40 is Asp, Ala, Cys, Glu, Phe, Gly, His, Ile, Lys, Leu, Met, Asn, Gln, Arg, Ser, Thr, Val, Trp or Tyr;
Xaa at position 42 is Ser, Asn, Thr, Ala, Cys, Asp, Glu, Phe, Gly, Ile, Lys, Leu, Met, Arg, Val, Trp, Tyr or Gln;
Xaa at position 44 is Ser, Asp, Ala, Leu, Thr, Glu, Ile, Ala, Gly, Leu, Met, Asn, Pro, Gln, Val, Tyr or Val;
Xaa at position 45 is Arg, Lys or Ser;
Xaa at position 46 is Gly, Ala or Gln;
Xaa at position 47 is Phe, Tyr Cys, Val or Trp;
Xaa at position 48 is Leu, Met, Ile, Cys, Phe, Met, Arg, Tyr or Val;
Xaa at position 49 is Leu, Met, Ile or Val;
Xaa at position 50 is Ser, Ala, Tyr, Cys, Asp, Ile, Met, Pro, Gln, Val or Thr;
Xaa at position 51 is Leu, Val, Ala, Cys, Met or Ile;
Xaa at position 52 is Lys, Cys, Phe, His, Ile, Leu, Met, Asn, Arg, Ser, Thr, Gln, Trp or Tyr;
Xaa at position 53 is Lys, Arg, Met, Leu, Ile, Ala, Cys, Asp, Glu, Phe, His, Asn, Gln, Ser, Thr, Tyr or Val;
Xaa at position 54 is Asn, Cys, Asp, Glu, Phe, Gly, Lys, Met, Gln, Arg, Ser or Trp;
Xaa at position 55 is Gly, Ser or Thr;
Xaa at position 56 is Ala, Thr, Gln, Ser, Gly, Leu, Pro, Arg or Asn;

Xaa at position 57 is Gln, Glu, Leu, Met, Ser, Val, Ala, Asn, Ile or Thr;
Xaa at position 58 is His, Ala, Lys, Asp, Phe, Leu, Met, Asn, Arg, Trp, Tyr or Thr;
Xaa at position 59 is Pro, Thr or Ser;
Xaa at position 60 is Tyr, Glu or Phe;
Xaa at position 62 is Val, Ile or Leu;
Xaa at position 63 is Gln, Ser, Cys, Gly, Ile, Leu, Met, Asn, Thr, Val or Tyr;
Xaa at position 64 is Ala, Gln, Asn, Phe, Gly, His, Arg, Ser or Tyr;
Xaa at position 65 is Ser, Ala, Cys, Asp, Glu, Phe, Gly, His, Ile, Leu, Asn, Val or Thr;
Xaa at position 66 is Ser, Ala or Gly;
Xaa at position 67 is Lys, Gln, Asn or Arg;
Xaa at position 67 is Lys, Ala, Cys, Asp, Phe, His, Ile, Leu, Met, Asn, Gln, Arg, Ser, Thr, Val, Trp or Tyr;
Xaa at position 68 is Ile Asp, Leu or Val;
Xaa at position 69 is Glu, Ala, Cys, Asp, Phe, His, Ile, Leu, Met, Gln, Arg, Ser, Thr, Val or Tyr;
Xaa at position 70 is Val, Ile, Cys or Leu;
Xaa at position 71 is Asp, Glu, Tyr, Ala, Cys, Gly, His, Ile, Leu, Met, Asn, Ser, Thr, Val or Trp;
Xaa at position 72 is Asn, Ala, Cys, Asp, Glu, Gly, Lys, Met, Pro, Gln, Arg, Ser, Thr, Val, His or Trp;
Xaa at position 73 is Asn, Ser, Asp, Gln, Thr, Ala, Cys, Phe, Gly, His, Ile, Leu, Val, Tyr or Glu;
Xaa at position 74 is Ala, Thr, Met, Ile, Lys, Ser, Leu, Val, Cys, Asp, Phe, Gly, His, Asn, Gln, Tyr or Arg;
Xaa at position 75 is Val, Cys, Ile or Leu;
Xaa at position 76 is Lys, Ala, Cys, Phe, His, Ile, Leu, Gln, Arg, Ser, Thr, Val, Trp or Tyr;
Xaa at position 77 is Asp Tyr;
Xaa at position 78 is Gln, His, Ser, Asn, Ala, Cys, Asp, Phe, Gly, Ile, Leu, Met, Asn, Arg, Val, Tyr or Thr;
Xaa at position 79 is Gly, Arg, Ala, Cys, Asp, Glu, Phe, His, Lys, Leu, Asn, Gln, Arg, Ser, Thr, Trp or Tyr;
Xaa at position 80 is Arg, Glu, Gln, Lys, Asp, Ala, Cys, Phe, Gly, His, Ile, Leu, Ser, Thr, Val, Tyr or Asn;
Xaa at position 81 is Leu, Pro, Thr, Ile, Val, Ala, Cys, Asp, Phe, Gly, His or Ser;
Xaa at position 82 is Ile, Ala, Leu, Met, Arg and Val;
Xaa at position 83 is Glu, His, Asn, Leu, Gln, Ile, Ala, Cys, Asp, Phe, Gly, Lys, Pro, Arg, Ser, Thr, Tyr or Val;
Xaa at position 84 is Pro, Ala, Cys, Glu, Ile, Ser, Val, Trp or Tyr;
Xaa at position 85 is Leu, Val, Cys, Gly or Ala; and
Xaa at position 86 is Ser, Ala, Tyr, Asn, Ile, Val or Thr.

6. The DNA construct of claim 1, wherein the encoded PIP-72 polypeptide comprises an amino acid motif as represented by positions 37-51 of SEQ ID NO: 846, SEQ ID NO: 847, SEQ ID NO: 848 or SEQ ID NO: 849.

7. A DNA construct comprising a chimeric nucleic acid molecule encoding a chimeric PIP-72 polypeptide comprising at least a first moiety comprising a portion of a first PIP-72 polypeptide encoded by the nucleic acid molecule of claim 1 and a second moiety comprising a complementary portion of a second PIP-72 polypeptide encoded by the nucleic acid molecule of claim 1, wherein the first PIP-72 polypeptide and second PIP-72 polypeptide have different amino acid sequences in the corresponding portions.

8. An isolated polynucleotide comprising a nucleic acid molecule encoding a chimeric PIP-72 polypeptide comprising at least a first moiety comprising a portion of a first PIP-72 polypeptide encoded by the nucleic acid molecule of claim 1 and a second moiety comprising a complementary portion of a second PIP-72 polypeptide encoded by the nucleic acid molecule of claim 1, wherein the first PIP-72 polypeptide and second PIP-72 polypeptide have different amino acid sequences in the corresponding portions.

9. An expression cassette comprising the isolated polynucleotide of claim 8 operably linked to a heterologous regulatory element.

10. The expression cassette of claim 9, wherein the regulatory element is a promoter capable of expressing a protein in plants.

11. A transgenic plant comprising the DNA construct of claim 1.

12. A transgenic plant stably transformed with the DNA construct claim 1.

13. A seed produced from the plant of claim 11 or 12, wherein the seed comprises the nucleic acid molecule.

14. A progeny plant produced from the seed of claim 13.

15. A host cell transformed with the DNA construct of claim 1.

16. The host cell of claim 15, wherein the host cell is a bacterial cell or a plant cell.

17. The host cell of claim 16, wherein the plant cell is a monocot or dicot plant cell.

18. A recombinant PIP-72 polypeptide having insecticidal activity against Western corn rootworm (*Diabrotica virgifera virgifera*) comprising an amino acid sequence having at least 80% sequence identity to SEQ ID NO: 2 fused to a heterologous signal peptide or transit peptide.

19. The recombinant PIP-72 polypeptide of claim 18, wherein the PIP-72 polypeptide comprises 1 to 17 amino acid substitutions at position 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 57, 58, 59, 60, 62, 63, 64, 65, 66, 67, 68, 69, 70, 71, 72, 73, 74, 75, 76, 77, 78, 79, 80, 81, 82, 83, 84, 85 or 86, compared to the corresponding amino acid of SEQ ID NO: 2.

20. The recombinant PIP-72 polypeptide of claim 18, wherein the PIP-72 polypeptide comprises 1 to 17 amino acid substitutions at position 2, 3, 4, 5, 6, 7, 8, 9, 10, 11, 12, 13, 14, 15, 17, 18, 19, 20, 22, 23, 24, 25, 26, 27, 28, 29, 30, 31, 32, 33, 34, 35, 36, 37, 38, 39, 40, 42, 44, 45, 46, 47, 48, 49, 50, 51, 52, 53, 54, 56, 58, 60, 63, 64, 65, 66, 67, 68, 69, 70, 71, 72, 73, 74, 75, 76, 77, 78, 79, 80, 81, 82, 83, 84, 85 or 86 compared to the corresponding amino acid of SEQ ID NO: 2.

21. The recombinant PIP-72 polypeptide of claim 18, wherein the PIP-72 polypeptide comprises an amino acid sequence of the formula:

wherein

Xaa at position 2 is Gly, Ala, Cys, Asp, Glu, Ile, Lys, Leu, Asn, Arg, Ser, Thr, Val, Trp or Tyr;

Xaa at position 3 is Ile or Trp;

Xaa at position 4 is Thr, Ala, Asp, Glu, His, Ile, Lys, Leu, Arg, Ser, Val, Trp or Tyr;

Xaa at position 5 is Val, Ala, Cys, Gly, His, Ile or Tyr;

Xaa at position 6 is Thr, Ala, Cys, Phe, Gly, His, Ile, Lys, Met, Pro, Gln, Arg, Ser, Trp or Tyr;

Xaa at position 7 is Asn, Ala or Val;

Xaa at position 8 is Asn, Ala, Cys, Asp, Glu, Gly, His, Ile, Lys, Leu, Met, Gln, Arg, Ser, Thr or Val;

Xaa at position 9 is Ser, Ala, Cys, Gly or Thr;

Xaa at position 10 is Ser, Ala, Glu, Phe, Gly, His, Ile, Lys, Leu, Asn, Pro, Gln, Arg, Thr or Trp;

Xaa at position 11 is Asn, Ala, Cys, Asp, Glu, Gly, His, Ile, Lys, Leu, Met, Gln, Ser, Thr, Val or Tyr;

Xaa at position 12 is Pro, Ala, Cys, Asp, Glu, Gly, His, Lys, Leu, Asn, Gln, Arg, Ser, Thr, Val, Trp or Tyr;

Xaa at position 13 is Ile, Asn, Gln or Val;

Xaa at position 14 is Glu, Ala, Cys, Phe, His, Lys or Gln;

Xaa at position 15 is Val, Ala, Cys, Ile, Met or Arg;

Xaa at position 17 is Ile, Glu or Val;

Xaa at position 18 is Asn or Ser;

Xaa at position 19 is His, Ala, Glu, Lys, Leu, Pro, Arg, Ser or Tyr;

Xaa at position 20 is Trp, Ala or Thr;

Xaa at position 22 is Ser, Ala, Asp, Phe, Gly, His, Ile, Lys, Leu, Met, Asn, Pro, Gln, Arg, Thr, Val or Tyr;

Xaa at position 23 is Asp, Ala, Gly, His, Lys, Met, Asn, Gln, Ser, Thr or Val;

Xaa at position 24 is Gly, Asp or Phe;

Xaa at position 25 is Asp, Ala, Glu, Phe, Asn or Gln;

Xaa at position 26 is Thr, Glu or Pro;

Xaa at position 27 is Ser, Ala, Cys, Asp, Glu, Phe, Gly, His, Asn, Gln, Arg or Thr;

Xaa at position 28 is Phe, Pro, Trp or Tyr;

Xaa at position 29 is Phe, Ala, Cys, Ile, Leu, Gln, Arg, Trp or Tyr;

Xaa at position 30 is Ser, Ala, Cys, Asp, Glu, Phe, Gly, His, Lys, Leu, Met, Asn, Pro, Gln, Arg, Thr, Val, Trp or Tyr;

Xaa at position 31 is Val, Ile or Leu;

Xaa at position 32 is Gly, Ala, Asp, Glu, Phe, His, Lys, Leu, Met, Asn, Pro, Gln, Arg, Ser, Thr, Val, Trp or Tyr;

Xaa at position 33 is Asn, Ala, Cys, Asp, Glu, Phe, Gly, His, Ile, Lys, Leu, Pro, Gln, Arg, Ser, Thr, Val or Tyr;

Xaa at position 34 is Gly, Glu, Phe, His, Lys, Leu, Met, Asn, Gln, Arg, Ser, Thr or Tyr;

```
                                                          SEQ ID NO: 846
Met Xaa Xaa Xaa Xaa Xaa Xaa Xaa Xaa Xaa Xaa Xaa Xaa Xaa Xaa Ala
1               5                   10                  15

Xaa Xaa Xaa Xaa Gly Xaa Xaa Xaa Xaa Xaa Xaa Xaa Xaa Xaa Xaa
            20                  25                  30

Xaa Xaa Xaa Xaa Xaa Xaa Xaa Xaa Arg Xaa Asp Xaa Xaa Xaa Xaa Xaa
            35                  40                  45

Xaa Xaa Xaa Xaa Xaa Xaa Gly Xaa Gln Xaa Pro Xaa Tyr Val Xaa Xaa
        50                  55                  60

Xaa Xaa Xaa Xaa Xaa Xaa Xaa Xaa Xaa Xaa Xaa Xaa Xaa Xaa Xaa
65                  70                  75                  80

Xaa Xaa Xaa Xaa Xaa Xaa
                85
```

Xaa at position 35 is Lys, Ala, Cys, Asp, Gly, His, Ile, Leu, Met, Asn, Gln, Arg, Ser, Thr or Val;
Xaa at position 36 is Gln, Ala, Cys, Glu, Gly, His, Ile, Lys, Leu, Asn, Pro, Arg, Ser, Thr or Val;
Xaa at position 37 is Glu, Ala, Cys, Asp, Phe, Gly, Ile, Lys, Leu, Met, Asn, Ser, Thr or Val;
Xaa at position 38 is Thr, Ala, Cys, Asp, Glu, Phe, Gly, His, Ile, Leu, Met, Asn, Gln, Arg, Ser, Val, Trp or Tyr;
Xaa at position 39 is Trp or Phe;
Xaa at position 40 is Asp, Ala, Cys, Glu, Phe, Gly, His, Ile, Lys, Leu, Met, Asn, Gln, Arg, Ser, Thr, Val, Trp or Tyr;
Xaa at position 42 is Ser, Ala, Cys, Asp, Glu, Phe, Gly, Ile, Lys, Leu, Met, Asn, Gln, Arg, Thr, Val, Trp or Tyr;
Xaa at position 44 is Ser, Ala, Asp, Glu, Gly, Leu, Met, Asn, Pro, Gln, Thr, Val or Tyr;
Xaa at position 45 is Arg, Lys or Ser;
Xaa at position 46 is Gly, Ala or Gln;
Xaa at position 47 is Phe, Cys, Val or Tyr;
Xaa at position 48 is Val, Ile or Leu;
Xaa at position 49 is Leu, Cys, Phe, Met, Arg or Tyr;
Xaa at position 50 is Ser, Ala, Cys, Asp, Ile, Met, Pro, Gln, Thr or Val;
Xaa at position 51 is Leu, Ala, Cys, Met or Val;
Xaa at position 52 is Lys, Cys, Phe, His, Ile, Leu, Met, Asn, Arg, Ser, Thr, Trp or Tyr;
Xaa at position 53 is Lys, Ala, Cys, Asp, Glu, Phe, His, Ile, Leu, Met, Asn, Gln, Arg, Ser, Thr, Val or Tyr;
Xaa at position 54 is Asn, Cys, Asp, Glu, Phe, Gly, Lys, Met, Gln, Arg, Ser or Trp;

Xaa at position 72 is Asn, Ala, Cys, Asp, Glu, Gly, Lys, Met, Pro, Gln, Arg, Ser, Thr, Val or Trp;
Xaa at position 73 is Asn, Ala, Cys, Asp, Phe, Gly, His, Ile, Leu, Ser, Thr, Val or Tyr;
Xaa at position 74 is Ala, Cys, Asp, Phe, Gly, His, Ile, Leu, Asn, Gln, Arg, Ser, Thr, Val or Tyr;
Xaa at position 75 is Val, Cys, Ile or Leu;
Xaa at position 76 is Lys, Ala, Cys, Phe, His, Ile, Leu, Gln, Arg, Ser, Thr, Val, Trp or Tyr;
Xaa at position 77 is Asp Tyr;
Xaa at position 78 is Gln, Ala, Cys, Asp, Phe, Gly, His, Ile, Leu, Met, Asn, Arg, Ser, Thr, Val or Tyr;
Xaa at position 79 is Gly, Arg, Ala, Cys, Asp, Glu, Phe, His, Lys, Leu, Asn, Gln, Arg, Ser, Thr, Trp or Tyr;
Xaa at position 80 is Arg, Ala, Cys, Asp, Phe, Gly, His, Ile, Leu, Asn, Ser, Thr, Val or Tyr;
Xaa at position 81 is Leu, Ala, Cys, Asp, Phe, Gly, His, Ile, Asn, Pro, Arg, Ser, Thr or Val;
Xaa at position 82 is Ile, Ala, Leu, Met, Arg or Val;
Xaa at position 83 is Glu, Ala, Cys, Asp, Phe, Gly, His, Ile, Lys, Leu, Asn, Pro, Arg, Ser, Thr, Val or Tyr;
Xaa at position 84 is Pro, Ala, Cys, Glu, Ile, Ser, Val, Trp or Tyr;
Xaa at position 85 is Leu, Cys, Gly or Val; and
Xaa at position 86 is Ser, Ala, Ile, Thr or Val.

22. The recombinant PIP-72 polypeptide of claim 18, wherein the PIP-72 polypeptide comprises an amino acid sequence of the formula:

```
                                                      SEQ ID NO: 849
Met Xaa Xaa Xaa Xaa Xaa Xaa Xaa Xaa Ser Xaa Xaa Xaa Xaa Xaa
1               5                   10                  15

Xaa Xaa Xaa Xaa Xaa Xaa Xaa Xaa Xaa Xaa Xaa Xaa Xaa Xaa Xaa
            20                  25                  30

Xaa Xaa Xaa Xaa Xaa Xaa Xaa Xaa Arg Xaa Asp Xaa Xaa Xaa Xaa
            35                  40                  45

Xaa Xaa Xaa Xaa Xaa Xaa Xaa Xaa Xaa Xaa Xaa Tyr Xaa Xaa Xaa
        50                  55                  60

Xaa Xaa Xaa Xaa Xaa Xaa Xaa Xaa Xaa Xaa Xaa Xaa Xaa Xaa Xaa
65                  70                  75                  80

Xaa Xaa Xaa Xaa Xaa Xaa
            85
``` wherein
Xaa at position 2 is Gly, Ala, Cys, Asp, Glu, Ile, Lys, Leu, Asn, Arg, Ser, Thr, Val, Trp or Tyr;
Xaa at position 3 is Ile, Leu, Val or Trp;
Xaa at position 4 is Thr, Ala, Asp, Glu, His, Ile, Lys, Leu, Arg, Ser, Val, Trp or Tyr;
Xaa at position 5 is Val, Ala, Cys, Gly, His, Ile, Leu or Tyr;
Xaa at position 6 is Thr, Ala, Cys, Phe, Gly, His, Ile, Lys, Met, Pro, Gln, Arg, Ser, Trp or Tyr;
Xaa at position 7 is Asn, Ala or Val;
Xaa at position 8 is Asn, Lys, Gly, Ser, Gln, Arg, Thr, Ala, Cys, Asp, Glu, His, Ile, Leu, Met or Val;
Xaa at position 9 is Ser, Ala, Cys, Gly or Thr;
Xaa at position 11 is Asn, Lys, Thr, Gln, Arg, Ser, Ala, Cys, Asp, Glu, Gly, His, Ile, Leu, Met, Val or Tyr;
Xaa at position 12 is Pro, Thr, Lys, Ser, Arg, Ala, Cys, Asp, Glu, Gly, His, Leu, Asn, Gln, Arg, Val, Trp or Tyr;
Xaa at position 13 is Ile, Asn, Gln, Leu or Val;
Xaa at position 14 is Glu, Ala, Cys, Phe, His, Lys, Asp or Gln;

Xaa at position 56 is Ala, Gly, Leu, Asn, Pro, Gln, Arg, Ser or Thr;
Xaa at position 57 is Gln, Glu, Leu, Met, Ser or Thr;
Xaa at position 58 is His, Ala, Asp, Phe, Leu, Met, Asn, Arg, Trp or Tyr;
Xaa at position 60 is Tyr, Glu or Phe;
Xaa at position 63 is Gln, Cys, Gly, Ile, Leu, Met, Asn, Thr, Val or Tyr;
Xaa at position 64 is Ala, Phe, Gly, His, Arg, Ser or Tyr;
Xaa at position 65 is Ser, Ala, Cys, Asp, Glu, Phe, Gly, His, Ile, Leu, Asn, Thr or Val;
Xaa at position 66 is Ser, Ala or Gly;
Xaa at position 67 is Lys, Ala, Cys, Asp, Phe, His, Ile, Leu, Met, Asn, Gln, Arg, Ser, Thr, Val, Trp or Tyr;
Xaa at position 68 is Ile Asp, Leu or Val;
Xaa at position 69 is Glu, Ala, Cys, Asp, Phe, His, Ile, Leu, Met, Gln, Arg, Ser, Thr, Val or Tyr;
Xaa at position 70 is Val, Cys, Ala or Ile;
Xaa at position 71 is Asp, Ala, Cys, Gly, His, Ile, Leu, Met, Asn, Ser, Thr, Val or Tyr;

Xaa at position 15 is Val, Ala, Ile, Leu, Cys, Met or Arg;
Xaa at position 16 is Ala or Ser;
Xaa at position 17 is Ile, Glu, Leu or Val;
Xaa at position 18 is Asn, Gln, Thr or Ser;
Xaa at position 19 is His, Lys, Ala, Arg, Glu, Leu, Pro, Ser or Tyr;
Xaa at position 20 is Trp, Ala or Thr;
Xaa at position 21 is Gly, Arg or Lys;
Xaa at position 22 is Ser, Ala, Asp, Phe, Gly, His, Ile, Lys, Leu, Met, Asn, Pro, Gln, Arg, Thr, Val or Tyr;
Xaa at position 23 is Asp, Ala, Gly, His, Lys, Met, Asn, Gln, Ser, Thr or Val;
Xaa at position 24 is Gly, Asp or Phe;
Xaa at position 25 is Asp, Ala, Glu, Phe, Asn or Gln;
Xaa at position 26 is Thr, Glu, Asp, Ser or Pro;
Xaa at position 27 is Ser, Thr, Lys, Arg, Ala, Cys, Asp, Glu, Phe, Gly, His, Asn or Gln;
Xaa at position 28 is Phe, Tyr, Pro or Trp;
Xaa at position 29 is Phe, Ala, Cys, Ile, Leu, Gln, Arg, Trp or Tyr;
Xaa at position 30 is Ser, Gly, Lys, Thr, Arg, Ala, Cys, Asp, Glu, Phe, His, Leu, Met, Asn, Pro, Gln, Val, Trp or Tyr;
Xaa at position 31 is Val, Ile, Met or Leu;
Xaa at position 32 is Gly, Ala, Asp, Glu, Phe, His, Lys, Leu, Met, Asn, Pro, Gln, Arg, Ser, Thr, Val, Trp or Tyr;
Xaa at position 33 is Asn, Ser, Gln, Pro, Thr, Ala, Cys, Asp, Glu, Phe, Gly, His, Ile, Lys, Leu, Arg, Val or Tyr;
Xaa at position 34 is Gly, Glu, Phe, His, Lys, Leu, Met, Asn, Gln, Arg, Ser, Thr or Tyr;
Xaa at position 35 is Lys, Glu, Ala, Cys, Asp, Gly, His, Ile, Leu, Met, Asn, Gln, Arg, Ser, Thr or Val;
Xaa at position 36 is Gln, Ala, Cys, Glu, Gly, His, Ile, Lys, Leu, Asn, Pro, Arg, Ser, Thr or Val;
Xaa at position 37 is Glu, Asp, Ala, Cys, Phe, Gly, Ile, Lys, Leu, Met, Asn, Ser, Thr or Val;
Xaa at position 38 is Thr, Ser, Ala, Cys, Asp, Glu, Phe, Gly, His, Ile, Leu, Met, Asn, Gln, Arg, Val, Trp or Tyr;
Xaa at position 39 is Trp or Phe;
Xaa at position 40 is Asp, Ala, Cys, Glu, Phe, Gly, His, Ile, Lys, Leu, Met, Asn, Gln, Arg, Ser, Thr, Val, Trp or Tyr;
Xaa at position 42 is Ser, Asn, Thr, Ala, Cys, Asp, Glu, Phe, Gly, Ile, Lys, Leu, Met, Arg, Val, Trp, Tyr or Gln;
Xaa at position 44 is Ser, Asp, Ala, Leu, Thr, Glu, Ile, Ala, Gly, Leu, Met, Asn, Pro, Gln, Val, Tyr or Val;
Xaa at position 45 is Arg, Lys or Ser;
Xaa at position 46 is Gly, Ala or Gln;
Xaa at position 47 is Phe, Tyr Cys, Val or Trp;
Xaa at position 48 is Leu, Met, Ile, Cys, Phe, Met, Arg, Tyr or Val;
Xaa at position 49 is Leu, Met, Ile or Val;
Xaa at position 50 is Ser, Ala, Tyr, Cys, Asp, Ile, Met, Pro, Gln, Val or Thr;
Xaa at position 51 is Leu, Val, Ala, Cys, Met or Ile;
Xaa at position 52 is Lys, Cys, Phe, His, Ile, Leu, Met, Asn, Arg, Ser, Thr, Gln, Trp or Tyr;
Xaa at position 53 is Lys, Arg, Met, Leu, Ile, Ala, Cys, Asp, Glu, Phe, His, Asn, Gln, Ser, Thr, Tyr or Val;
Xaa at position 54 is Asn, Cys, Asp, Glu, Phe, Gly, Lys, Met, Gln, Arg, Ser or Trp;
Xaa at position 55 is Gly, Ser or Thr;
Xaa at position 56 is Ala, Thr, Gln, Ser, Gly, Leu, Pro, Arg or Asn;
Xaa at position 57 is Gln, Glu, Leu, Met, Ser, Val, Ala, Asn, Ile or Thr;
Xaa at position 58 is His, Ala, Lys, Asp, Phe, Leu, Met, Asn, Arg, Trp, Tyr or Thr;
Xaa at position 59 is Pro, Thr or Ser;
Xaa at position 60 is Tyr, Glu or Phe;
Xaa at position 62 is Val, Ile or Leu;
Xaa at position 63 is Gln, Ser, Cys, Gly, Ile, Leu, Met, Asn, Thr, Val or Tyr;
Xaa at position 64 is Ala, Gln, Asn, Phe, Gly, His, Arg, Ser or Tyr;
Xaa at position 65 is Ser, Ala, Cys, Asp, Glu, Phe, Gly, His, Ile, Leu, Asn, Val or Thr;
Xaa at position 66 is Ser, Ala or Gly;
Xaa at position 67 is Lys, Gln, Asn or Arg;
Xaa at position 67 is Lys, Ala, Cys, Asp, Phe, His, Ile, Leu, Met, Asn, Gln, Arg, Ser, Thr, Val, Trp or Tyr;
Xaa at position 68 is Ile Asp, Leu or Val;
Xaa at position 69 is Glu, Ala, Cys, Asp, Phe, His, Ile, Leu, Met, Gln, Arg, Ser, Thr, Val or Tyr;
Xaa at position 70 is Val, Ile, Cys or Leu;
Xaa at position 71 is Asp, Glu, Tyr, Ala, Cys, Gly, His, Ile, Leu, Met, Asn, Ser, Thr, Val or Trp;
Xaa at position 72 is Asn, Ala, Cys, Asp, Glu, Gly, Lys, Met, Pro, Gln, Arg, Ser, Thr, Val, His or Trp;
Xaa at position 73 is Asn, Ser, Asp, Gln, Thr, Ala, Cys, Phe, Gly, His, Ile, Leu, Val, Tyr or Glu;
Xaa at position 74 is Ala, Thr, Met, Ile, Lys, Ser, Leu, Val, Cys, Asp, Phe, Gly, His, Asn, Gln, Tyr or Arg;
Xaa at position 75 is Val, Cys, Ile or Leu;
Xaa at position 76 is Lys, Ala, Cys, Phe, His, Ile, Leu, Gln, Arg, Ser, Thr, Val, Trp or Tyr;
Xaa at position 77 is Asp Tyr;
Xaa at position 78 is Gln, His, Ser, Asn, Ala, Cys, Asp, Phe, Gly, Ile, Leu, Met, Asn, Arg, Val, Tyr or Thr;
Xaa at position 79 is Gly, Arg, Ala, Cys, Asp, Glu, Phe, His, Lys, Leu, Asn, Gln, Arg, Ser, Thr, Trp or Tyr;
Xaa at position 80 is Arg, Glu, Gln, Lys, Asp, Ala, Cys, Phe, Gly, His, Ile, Leu, Ser, Thr, Val, Tyr or Asn;
Xaa at position 81 is Leu, Pro, Thr, Ile, Val, Ala, Cys, Asp, Phe, Gly, His or Ser;
Xaa at position 82 is Ile, Ala, Leu, Met, Arg and Val;
Xaa at position 83 is Glu, His, Asn, Leu, Gln, Ile, Ala, Cys, Asp, Phe, Gly, Lys, Pro, Arg, Ser, Thr, Tyr or Val;
Xaa at position 84 is Pro, Ala, Cys, Glu, Ile, Ser, Val, Trp or Tyr;
Xaa at position 85 is Leu, Val, Cys, Gly or Ala; and
Xaa at position 86 is Ser, Ala, Tyr, Asn, Ile, Val or Thr.

23. The recombinant PIP-72 polypeptide of claim 18, wherein the PIP-72 polypeptide comprises an amino acid motif as represented by positions 37-51 of SEQ ID NO: 846, SEQ ID NO: 847, SEQ ID NO: 848 or SEQ ID NO: 849.

24. A chimeric PIP-72 polypeptide comprising at least a first moiety comprising a portion of a first PIP-72 polypeptide of claim 18 and a second moiety comprising a complementary portion of a second PIP-72 polypeptide of claim 18, wherein the first PIP-72 polypeptide and second PIP-72 polypeptide have different amino acid sequences in the corresponding portions.

25. A composition comprising the recombinant PIP-72 polypeptide of claim 18.

26. A fusion protein comprising the PIP-72 polypeptide of claim 18.

27. A method for controlling corn rootworm, comprising contacting an insect pest population with an insecticidally-effective amount of the PIP-72 polypeptide of claim 18.

28. A method of inhibiting growth or killing corn rootworm, comprising contacting the insect with a composition comprising an insecticidally-effective amount of the PIP-72 polypeptide of claim 18.

29. A method for controlling a corn rootworm population resistant to a pesticidal protein, comprising contacting the insect population with an insecticidally-effective amount of the PIP-72 polypeptide of claim 18.

30. A method of controlling a corn rootworm infestation in a transgenic plant and providing insect resistance management, comprising expressing in the plant the PIP-72 polypeptide of claim 18.

\* \* \* \* \*